United States Patent 9,677,139 (GENETIC MARKERS INDICATIVE OF A CANCER PATIENT RESPONSE TO TRASTUZUMAB (HERCEPTIN)) - sequence listing, part 4

SEQ ID NO: 1 - DNA, 15429001 bp, Homo sapiens (residues 6,612,430-8,816,572 of 15,429,001)
aaatcaacaaaaatattcataggcattaaacatctattaaaacactaaatattaaaagtaagtgaggaaagtgtgcaaatgaaaagtataaaagaaacaattatagggagaaaacacaaaagaatattaaaacaaataataaataacaaaactataaagtaaaagatgattctttaaaagaattcgagataagaattatataaaattgtgattaaatatttaagatgatacaaaggatatatataaggaactactaagaagatatatctataaagtaaaaaataataagataatgttatggccaacatttcaaactaaatctgaaaatttaacaacatggaaaatacctagggaattctatacacccaaatcaatcacagaatgtatggaaaatcagcaacaattgaataatatataaatacttgtttttaaaaattgaggctataattagtcctctgcttttatctacctcaagccccaaatgttttttacatgtgatttttgccaaacttttaagaaatacataatccctaacttgtacaaagttctaaagaaaaaaaattaaggcattttaccaactcatcttataagtttaatacaaatttaatatgcaaataggacgagtacaatacagcattataggccaatttcagatccaaacaaattgagagaaaagttaaagttatagcaaattcttccactatctatagtaataatagagcataaccatgtagagtttatccaagaataatctagaatcagaagaaaatctatcaatataatttactaaattagcaccttaagagaaaaaaataatatgaactactcaatagatgaagataataaaattgatgtctagttttactcatgaaaaagatacttgcaaaatgaagaacagatggaaacttctgtaatctggttttaggtttctaccaaaaacctaagttaagatactaaagatttatattttagaaaataaatgccactggccattgaaataagaattaagaaaaagaatgcaagttactgatgctcttattttacataagggcaaagcccctaggcagagatagtagataataaataaaaaatcagaaatatgaaaataggaaagtaggccgggcacagtggctcatgttggtaatcccagcactttgggaggccgaggcaggctgatcatgaggtcaggagtttcagactagcctggcaaacctggtgaaaccccatctctactaaaaataaattagccaggcgtggtggcaggcacctgtaacccaagctactcaggaggcttaggcaggagaatcacttgaaccaggtagacagaggttgcagtgagccgagatcatgcagctgcactccaacctaggtgacagagtgagaccctgtctcaaaaaaaaaaacaaaaaatatatatatatagatagatagatagatagatagatatgaatgaaataaatgaaaacacaacagactccatactggggaaaataaataaataggaaagttacagaaaaaaaattgacatttgttgcctaaatttaaaaatccaagagtagttttagaaaaccattagacaagtaaaagaatacattagggttactagatttagtcaaaaaccaatagagtttctttttaagcattaatgatcaaataaaaaatccaaggcaactcaatgaaaatagaaatagacctagaagttacttaatataagtaacatatcaacaataccttgtttagaaaattagataacattatttgatgacataaatcaaactggaataaataaagaaccacatcaccttcacggatggataatctcattattttaaagatggcaattaattccaaattaatatataaatgcagtggaccaaaacaagctaatattaaaattatttttagttatataacttaataaatagacaagattttgtaagtagaataaggagagaaatttatttaaccatctaccagatatactaggaagtttcacaatatttacttccaaaaattttaattccactaaatatagaacaaagacaagagagttgctgatgttaacttggatgattaaccaactatagatttagacacgatttgagggtgacgtaaaataacacctaattaaatttatctccatggatttattaaggtaagtatttcctttggttatcaaggaaggctatgccaataaaaacagcatcttcaagcactgtgtttattacatgaggaactgtgcacacatagataaaaatgcagaagtaacccctctgaatttatcagagactatatgtagtagttcgaatgtatgtagtagttcgaatgtatgtgtccctccaaaattcacatgttggaacttaatatcctatgtaatggtattaagaggtggggcctttggagaagtgagtaggttctgaacatcccgcccttatgaacaggattagtgttcttatagaagaggttgatgggagtgcctagtcccttgtgcccttctgtcttcccctatgtgaggctgtagcaacaagatgccatattagtagcagagagtaaatcttcaccagacactacatctgctggcaccttgaccttttactttgcagcctccagaactgtgagaaataaattgctgttgtttgtaaattacctagtccgtggtattttgttatagcagcaggaacggattaagacactagccaaacctcttcttgggatgtaatgtcttttccttattactgtgtaaaagaccgctgcactgccatgaaccagctctttgatttaacatgcaggaaaaaaaaaaaaaaaaacatgtacgatatggctttcgatccttttaccttaatgagatcttagtctccttccatttatttgtttgtcacctgtacaacctaaaattgtcagatacctaaatatttctttaaaattaccacaggtttactgcacgttacactttagtgaatgcccttaagcccagaacaacaaatataatgctctgtttaatcctttgagtacacattgtccatgtaaatagtccgtgtaatttatgaagaagtgacttcaattaaattgtgcctgtaactgaataagctaattcaaccatttcttaatatttaaattttaactgttattatacagcacagacatattatcattctttgaatgcattgctttttattttgtttgatgtttgtttaaagtgtgatattttgaatattagacatccatttatgtttttagctgccagatcatttttagtagatatttattggtggtagcaatcagagcttagcagaaatgattttttataaccattatttaaaatataataattgccatgacccattttgtttttcttgaagtaatagtgctggaaacttattctttgttccttactaaaacttttttttcctttttattttctacctgttgttaaagattgaattttcaaacttccctgtcacaggttcattatctggtaattaatgaaaactgtacttctcacatactggttttcaaatctgcttggaggccgggcgcagtggcttacacctgtaatcccagcagtttgggaagccgaggtgggcagatcacctgagttcaggagttcgagaccagcctggccaacatggtgaaaccctatctctactaaaaatacaaaaattagccaggcatggtggcaagggcctgtaatcccagctatatgggagacggaggcaggagaattgcttgaacccaggaagcggaggtttcagtgagccgagatcacaccatagcacacagcactccagcctgggcaacagagtgacattccatctcaaaaaaaaaaaaaaaaaaaaaaaaaagaataaaaccaaatctgctcagagacctatgtcaacagtaaattaagattttctcagatgtggcaatgtttttttgaaaatgctttcttttttattgcaagtcacggagactgtatctgataggtaaatgtgtttgtgtcctctaatgttcctagtagagattgacacatatatctacagcctaaatgggtgctagtgtggaaagacctctttcttgtcattaattttctcctcatctatgaacagttctttcacaattgatgagcactttatggtatgagccatttcattattatagctttacagtaggccagttaattcaaatattaaaaatatttcccctttcaaaatattttaaatatctatgttcatttgattttgtcttagttgttggctttcacatttattcttcttttctattgtatctgactacattataaatgtagagcttatacataggatctagagaaaatattttaaaatctacacttttgaactttcttactcctgttcaagcacatataacacactaatttttgaggaaaataatgaaatattttactctttttccatgttagttggcatcagaggtcaactcacatcctctttagacagtagcaattaattcaggaattggccttttctttccaattattagcaaagatttgttgcctgtcacagccttcccgcaagttttaggttatagaaattgtgaaaacatttttcagcctgtcttaggtctgaacacacccttccacgtaagcatagccattaatgactatactcaatttgtgtatccaaatttctgtcagaagccaaactgagccctggtcctcaccaactgtgtttcaagttgctatttaaaaggatgagaaaggaaaacatgaaggatgtcctttctgcacacaacttataagtaattctaaaacatatttggtggctattttctgtgtatggaaggtagtttattttatacatgtaatttattgatatcaggagtgagaggctataatatatctaatttctgttcatttttaaacactttatatgttatggacattttatttttcaattatttttatatttattacataatacgttactttcaataacaatgtatagttggttagtaagaataacatatttaagaaataaaaaagtttaaaggcatttactttaattcaacagctattttttaattacaaaattaaataatagtagatttgggactagaaatgtaatcaaaacaagacgtctagtgtattattatttttattttataaataatgcttttaacattttatttcacctcaagccacatccttatgtccctgaattatgtatgtttgtgtaaaatattcaaaaaaattataattaaaaacagagaaggtaaaaataagtattcacataaaatatcatttttctttcagagtcattttagaaaaggcttatttaataaactttgctgcttttggggggaggtttttcttttggttttactcatctagttcttagtaacaaagattttaactttggcttggctcaatcacatattttctcttattttttaaaaactaaatttaatgttaataaaaattatatataatatacatctagtatcaagaataagaatacacaaatcaaatatatttgctcttgtctttcagtgtagttttaaaggctagtaaaattgaaatatgtgtaacttctaaatctaggagagggcataaaagtagagtaataaaaaaacatcccacaaagaaatagtcaatcaagtcagggaaagaaaaaaaaaaagaaaacttaaagagcaggacaaacagcataaaataagatggttaaaatcagtccaaagacgtatacgataaaaaacaaacataaaatgaaaccactagttaaaagatctactaatttaataaatctttactgaccacttacagcggattaaattttctaagtgttgcagcattgaacaaaacagaaaaaaatcattgtcctagaactcacatttcattagagaggcagacactagatgaataattaattgatagtagtaagtgtgatggaaaaaaggggtaatgagagttaccagtcctcgagcccatcctataagcccaggatagaactttcacaatgtggagtggcaggtgcagtgggagcttctactctggtggccttccctgcccaaccagatagatgccccatatgacagaactggggagatgggaacaccccttacctaaaataccacatacttccattgtttttatttagattcagcaaattttttgaagaaatatttatcaatgcattctatgccattttagtcaaatttcctcaaaaaatggttatttttaacaattgtgtcccattttattgtcttttgaaggaaggatttgccagactcctcacacagccattcaaaagcctcattccctgatttaattaactataaactcttcttccccccagactacttaaattttacttaccagtataactagttattttatatgacctaggtctaaaaggaagttagtgtaaatactgaattgcttgcttttaaaactagtatctagctactataaaatgtctctcaattgctatctaattttaccctagtgttccataggtgattctctgtactatcaattgctacaatatttcagccaaataagtaatatctgtatgacttcatagtatttattcacatagttattatgcactgcacaactgagaaatgctgaggcactaaatctcccattattaccggagaagatcttgtgtaaaagtatgtataatacaggctgctgtctgaaatctgctttaatttcaaaaccccctttcccaaatcatgtggattactttattgataatgaaaaacattttttaaataactttttataagtccacattctatgaaataaaacaagcagcaaaatatactgaaatagaggaggaaataaaagggctaacataaaataacttaaaagtatctctaaagctttagcaacctatgggtggctctttggaaaatattgcacatctctcaaaaatgttactgcctcttccacatccggttctactttcattttgtatgtaggttacaatggttaattttaacctggtcgtgaggtgcccaaatatttggttaaacatttttttttggtgtttctatgtgtgtgtgtctttggatgaaattaacatttaaagcagattgctcttgctaatatatgtgggcctctcccaatcagttgagggcctgaatacaacaaaaatgttcatccccccttgagtaggagagaatactttctgtctgatgttgaaatgggacatcagcttttcccctaccttttgactggcactgaggtatcagctctttttgggtcttgagactactggctttggactggaactataccattcactcccttggttttctggcttttgaacttgtactggaactatgccctcagctctcctatgtctccagcttcttaagtcacatgcagatcttaagagttgccaatatccataatcatgtgagccaattcctacaataaatatctctatatttggttctgtttctctgtatttcttcttcatcagagtagaattttactttaatttaaatgattgttcttttaattatcaattatccaaattataagaattctacaaacttgaaagaaatttaatcataaatcacaaaacctgtcacaaaaattaaagatgtaatttgtgcattgttataccaggaacaataagaagccacaagtatggcactctaagcgacaaaatgtataaatgttcaacacatatcatttgtggcttttcaaaatctctctaacacaaaggatgtccaactgtactgaaaagatattaatatactctatcatagtttgaataaatgcatttcaaacctacagcaagatagagtatgtctgcactgttctgtgtaatcacattatttttttctcaaattattaattaaacatacagtcaaaaatcaaaaatttcatctaggaagaatacatttatttatggaaaatattcttcactatcctgtgtctaggttacataaaacagccagtataaacagcaaataaaattgtaaaaattggaaagcataaatttattttttctattgattcttgtggcatagtacacaatttctaatatttaagaatatcaatttaatattaattctagaaatatgactgatgccaatcgtgttgtgctcactgtttaatctgttcattgtagatcacaactactagaaaattaatattttcccagatcttaaattattaaatatttcatttattgtattcaaatttaaaaaaaatcagcatcagtagttactaattggtagttttaagagcaaaaaaaaaaaaagtaatatgactttaaagtaacttctaacattatgtgaccttgagagagttactctgcctgtctggatctcatttttattatctaaaaatgatggtcacatgtaattgttcaggtaatttttttttcttttctactcttctctaataattggttatatatgttcaagggtaaatatgaagagtatattctgaatgagaattacatataagcatcaattttaactgcattctaagtttatatttaaagcatttaaacattattttcaaggacacaaatatatctcatatttattctcctgactagctgagttcatacatatcaaggttctgtcttctcctagtgtacaagctatgcttaatgtacatgctggtctcctcttcatcaaagatgtccttcttttctctcccttacctcaattttatcatcatttcaatgaaaaatagttatcactttatttccaggctttctcaaagccagggttacatcaaagttttccactcatgtaacttattttctttaaaatatagattcatcctcagaagcaatgctgctattaataattaaataatgccccctttatatttttacatatgaagtttcagaagcttcagataggaaatgataatttttccctgtccataaatatattcagcatataccattttatacatgaaggcaacacataaggaacgtttattctccatgtttcagtgcaccaaaggctctacacgatggtacatctaaaagaacctaaggagaaccattgtccaatgaccgcagaagtccttacaaaacttcatacttgactgccaaatgtgtaattctttgaggacttatttgcattttacaggtaatatattcaataaaatgttcatatctttagtcctgttgaattttgttatgacctacagtaacctgggcagtcactgaaaaggcatagcaggtgaaaaatggaattgtttgtatataatcagttcccttcagctatgatccttagcaaacccaatctggatcacctggattcaccctacatgagaggcagtgactaagaagaaagggaacataagaaggtttaacttggattcaggcaatatgaaattagagcctagcttaaaaattaggtgtacaagccatatcttctatcttggtcttagttctattatctgaataaaaaaatgagtttgatatttcaagaatttccagctatttgcttcatggttttctatggcaatttattaattactagcaatatgattactttgccttaagaaggtagtaagatttacagtaacatatgattacatttggaattcacaaattttggaaaggcaataaattacagtttcctatgggggatgcttttctcaaatttttattttagtgttcttgaacttcgttctcttaaggataatatattgaaccattaagatgatttttacttctaaccatttcagcataggaaaattcaacacaataagttatcttccattcatgtataccagtttttggagccacaaaacccttagatatgtctcctcttttaatgaaagtatgatgaatggaagaagattatgattatgcaaatgtagcatatattagagctgtattgcgtaaccctcaattttccctagttcaatgaacttaaacctagtgttagggatcaatgggaagacaaaccgtggtttaaggaaagccaacacattccattgataactaatgagtcattggtctgggagcaggtcttgccctcagactgaggactggaaaatagaggaatgaacatactatttctatttgtatttattttatctcaaataagagcttgaatgatcatgtaggggtactttatcaaggatgcctcccccaggttacttagacttgagggtaagttagctttttctatttctgaaaggttgggcttccgagtgagccacgttccaggctataaataaaagcagagtgattttaagaatcagaatacaaagcaggtgatgacagtggaaaactatgctgcctgggatagcaaagtcaataaaaagcagcacttagaggggaatattatattggaaaggcagagtccagaaagttgtttcagtggttgttaagaatcacttggagagcatgtcacaatacatgctaaaatccatgatctcaaactctgacaacatgaatcagaatctccagatgatcttgtggatctgatatttcaacaactaaaccaaataagtcttatgtgcaggtgtcttgaaaatcaatgttctttatcttttctcttgtacagtgactatggctatacattgaaaacacttagtggtgagcatttaaaatgatctatacacactcacctccagcccagttgaatgaaaatctctaatgtgtgcagcctggggattattgcctataagaaattccccaggtgattttaatatgcaatcacgtttgggaatcactggcaaaattgcagttatacatcagtgtttctcaaactttaaaatgcacagaaatcacccagataccttgtcaatttgaagattctgatttagctatggtgggacctgagcttctgcatttttaacaagcttgtaaatgatgtaaatgctgctggttcaaagatcattaagtagcagtggcctaaatcatgtgactattatagaatggaacagtgatcagttctgttacctgaccataatggctaaacaaaacaaccaaattataaattaaaaggggtttgaatatatagaacattcatttttcagctactagccaaaaaatactatctctacctgctatcccatgtgttgtgttctttttagactgtctaattttgagctgaactgtttcttagactgacagacaagtcataaatcaagtgattgctataaatgctttttatttatatagagagtgtctcagatttttacctttctttcataaacttgtcataaatttctaattcaccaatagatggttggtgtccatttttcttgagtctaagacacttttaaaaatttacttgacttggtcttttacgtactttcttcagagcctttcttactacatgtactaattcttgcctcctttgttctttgtctttcattgcaaagcagtagtttttcctggtttatagcatccatggtttaggatgctgaaatacttccagtaaggatgctgtaagtgaacattctgtaatcagctaagcacggaccatttttctctctttcctcttccctgtgatgataattttttggctactgttgaaattgtccccctgttgagctcagcagagaaggcttggtccattttcacatcagtagaaagaatgttcctatgaaatttttattcatctgccattgtttatcaaaaagtggtttcaatagcaatactagagttattatccacagtatatattgtgtagtcagtacaaataagaacattaaattgatgtttatattacaaacgaagtataatctacatttaggaatccttattttatacaaataattcatagcaaaatcttttaggatgattttgtcatcattagctttgagtgactgagctaagagtagagaggctaaaagcccctgataatttttagttccaaggattaaaattgtgcagagtttaaggtgttattttttttgagaaaacactttatagtatgtttttcatatactataattattaatttaatagaacaacataagtaattgatatatgttcattatagcttctacaggttttaacgaaaatgcaaaaaaatcctggatgtgcacagttttaaaaaatacttaaccaaattcaagaaagtcaaagtcttaacacatttaacacagcctctcatgtactaaatgaattacaactaaatggacctaagttctagaaaataaataatggaaaataatactatagtgacagagagatgaacaagaaggaaatgaccaactcttttctcatttttatgtctctaattcctttggctgggaacagctaggtagttcatgtgaaaagagcatttgtaaattcagttgagataaaaacaaaaaagaatataagaaaatcttttgtatttaagtataatttgtgtcttttcagtaagtctttcatgaatatattttggatttcagtgcaaatagtttaggtccaaatattaaaggtaatttaatgaacttaaactttcactctttcatcttacaaatcaaccccatatcttaaaattgtattcaataaatgtcttataattttcaggaagagacagcggaggaaaattattaatcaggtattcatttaaattattatttatttattttagatttgtaaatgtctctgcagaaatataatttgatcttgtttgagggttcataaagcacctccagaccacatatttcagtgttactactaaaaacatcaatttttattgtactccaaatatgtggtagtgctcaacgttctggataataaaatagtggagacacaagctttttattatactctggagtggagaatgatcccaccgagcatcttaatctctgaaatttctgggagaaagacacattcatctctacttcaaagttatgttagaacaatcttaagagaaggtcatgggtaaggtaaagcccacagaatcaatactcacaattttgtagattcattaagtttatgtatagcttgaacactttcagaggtgtctgccaaagggctatttataacaaaatatcaccactggggaataaaagtttcattttctagaacttctctttggctttatttcaaaatacagtgaaatcacccacacacatacacaccaccgccgccatccctgctaccacaagtagggaaatgtttaagccactgatgtaaaaatatgaattttattatcagaaaatgatcagccacaatttgtttgtttgtttgtttgtttgtttgtttcaggggattcatgtgcaagtttgtgaccagggtatattgcatgatgctgaggtttcggcttctatttaccccgtgacccaaatagtgaacataataccaaataggtagtttttcagctcttagctctgaagcaggtgcccatcctgaagcagcttcagtatctggggtaaatacccagggttcatcgtctggtgcccagaggattaacgacacggactcacacacatgagcgggttaaggagattcggaaactttaacagaaaaaaaggagagaaagagagagagcaagagagacagctttctcatacagagaaagtggattgcccacgagggtttctgggtttggggcaggatatgattgattttgtagacaggcttgaggaggaggtgactgatttacatagggcccaggggattggtttcaccggtgtgccatttacatagcccatgaagaaactgaccctcacacccgcaccttttattatgcaaatatggcttctacatggctagtgtcatgaaacctgcacacgtaggtttacctggcctgtgccatgatacccgcacacgtgacgaccatgaggagggagggggaatcgccatattgggtgcacctggcttttattacagctgccagtatttacatatgcaagcttcccagtttgcttgcagcttgacttttcaggctttctgttagaaaagaaattctggggctgctttttattaaagaaaaattccactgaaaactcttttaccctccctaactgcctaaaataatttcttaataacttctgtgttatctctcacctctagacccatgacaggcagtgctcaagttgtaggaacagcttgcacacagcttgagtgagtagaaaggaaataattttaaaaatcagaatgtaataaggaagcaaatacataatagaaaatttttaaaaagtcatccttttaagtaactaataaactttaatatcctaaatagtcttattaggagcaaagagagtagaaaaaatctactaacatcaagaatgaaaaaggggatatctctagagatcaaaaattttttaaatataataagactattacagacaagcgaacgcaaataaatgtgaaaatttggatagagaaaaaaaacacacaaatgaccaaacaaaaaaagaactataaaatttacatagttataaatgtattatacatttgaatctataattaaaacattaaaaagcaaaaagcaaacctcttcacacctagatggcttcatcaaacacaaaatctttcagaatgtagaaaaagagtgaacacttcccaagttattttatgagatcagtatgatcatttttttctaacagctcacaggtgttttctaagagtcaagttataggcccatttcctttataaaaatatatgcaaaaatcataagaaagtatatgaataaatcaaatctagccatacataagggtgatttaatgtttgcaagtcagtcaaataattaatcattttaccaaaataaggagaaaaacagggctatctaaagaactactaagcatatgaaaacatcatttgtcatcaaatgacaaaattataacaagattttatatgcagacactgtgttgttaaaaattttgatcatatcaactgttgtcaagaatggagaatgtagttttactctactgatggaggtataaattagtacaaccattttgaaaaaagcgtgtttgagaggatatagaggatatactcaatctggccaggcagtttctccccctatgtctacacccaacaaaacatgtacctgtatggggcagaaaaagtacttaagtattactagcagtattatctctaatagccccaatgcagaaacaacagaaacggccatcacgagtacaatgaacactttgtaatgtattcacacacacacacacaaaaaaaaaaacgtaaatagcaatctgattgaacaaattactctggcacaccattccctggattgaatctcatagatactatctgagttaaagagtgaaaagagcctttttaaaaagagtacgtaattgatgattccatttttcacaaatttgtaaaactggccaatccaatctatagtgtaagaatcagtgtggtggtgccctttagggagcagtagctgggatgctggggaggttttgggggtgttggccatgtcccacttcttcagctcagtcatggctacgtgggtgtgttcactttgcaaaactctgtcaaggtgtagcattctgatgggcttatttctatatgtatgttattcttaaaacaattgttaagatgaaaaaatcacatttatggaacatgaaaataaatagtgaggatattgaatatattttaatttaatcagggaaattggtaattttccacaaggagtggatttaaaggatattttatcaattctatgtttaatccttcctctaaaaacaacccaagtttactaatagtttgggggattaaataagcaactgaaatatcaataatttaaattctggccattatgaaacaataattgctccactggccaaacaagtggaactgaggggtcagggtagtgaggaatagggatcatttaaggagttacagctgttaagtctatctacatgtccacaaatggatggcaaagggacaattttctttcaaattagaagcagtgttttcacaattattcctttctgatttctcttttttttaaccctgacaaaaaaaaaaaaaaaaaaacacacagtaggtgtgtaaggggtgtggaagtttttggtacttatacttatttagggacagctgcactatagtacattacaactatctgctgccattgcccaagccgtaaacctgagagtgagcctcttccttctcccgcaaacctcacatttactcaatcaacagctcctgtgtattctgcttcctcattttctccaccctcacttgtacagtctgagtaatggctttagtcaactctcttccagactatgcacagcctcctaattattctctcagcctctcttgcccagtctgcatctgcacatttttcatacctactttgactttttgaaaatataaatattattgtattactaccctgcttaaagttcttcaggaagattctggaaagatagtggggtatcaccaggaatcagttttccttctggagagcaattgcactgactgaatctgtctaacatagctattttggaaatatggagtatattgaaggattgcaatctccaagggaaggcttgcacagtaaattatgcttgatgttggtcaatttcagcgcttagctctggatcagctgcctgtctctccctgtaagtgcatggcagacagtacacaagctacaagaccagcttgcatgcagcttgtgtgagccagtcttcaaccaatggtgagcaagccacaaggggagagaggaagaagagtaaaataaggtttttattccaccctctcctccctgtgtggtaaccaaccacaggaagatctctccatatagttctgtctccacagtaactgttcccagccattgctccttcaggtctaacagcctcagggtggcacaccaagccttgtagtttcctacacctttgtgaataatccctccaccagtgcaaatgatccacctggagtatgccatctatttcaccccaggacactaattgataaactcatttttctaattattcagaagctatatacatgctattaaaatttattcatatataattgaatcggcagtacaatatttcttgggatttatatctattctcatacattcctcctttgggacatgtaagttgtttgcagtttttcaagtcataaataattcaattattaacatatttgtgcctacagcttgtacttagactacttttcttggatataattctaacattaaaattaccaggtagtgtatgaataatttaaggacatttaactcataatgccaaattgcttttcccaagtgttgggctaacttatacttccaacaagcagtattagaacattgcttttccaatagtattgacattttagggcattatttttaatagtgactaatttcatagaactctcattccttgtatctactatgtaataaaaatacagcactcatatatcacccatatatatgtctcatttataaaccactcaatttgtctccccatgtagataaataaataagcttctcaaagacacctataagcaaataccttcctaatagagggggcacaaacagactgagcactcaacttgtttaaatcatgtaagggtaaaaagtgtcttacctgtgtgatgtcatcaaactatcaagaaatgagaccatgctttgagaagttccaggttcaaatcaggtagacagttccaacactgatttagcatgcataggagcgattagacaagaaggccaagaacaggctgagtaagtagtacagatgtcaagtctgtacaaccaaaacgttaggaatcaaacagtccatataaaaccaaacaggtaaaaagattatggggagagagaaacatcaactaatgaatgaatgaatgaggcataagattaagtgataggaggggcaaagcttaagtagttcctgacctgtggcacagattcctggagcaaagtgctagttactgagagttaatatttgtataaaatgcttggaacagtggctggtacatattaagtactacataagagtttgttaaatttcttcattcctaccaccagcatatacagagaccaaatcaatacaaatagcaaagttagtataacatgctagttttgaaatgattaatatgtaatatgtttttggaaattattagttgatttattcctttactcacaaatatttattcagtgtttaatatgtgtcaagctccctctagttgacagatatatagcagtcaataaaacagataaagcccctacttagagagaggcattaaatgaactaagaataaaatacactatcaggttgcaaaaatttcaaaataaaattatataaggcattagatatagtatgactgaggatgacatttgagacagaataatccaagcaatcctctatcatgtgatgctacttcataagagacctgatggaagtgaataaataaaccatacaaacctcatacacttgtgttctgggaagacagcccagtaaatacaaagactctgaggcatgccatgtgtattcacggaacattaagaggcctggataactggagttcggtgtgtgaaaaagaaagacattggatgtgaattaagagtggtagctagagtcggccgggcgtggtggctcacgcctgtaatcccatcactttgggaggcggatcacgaggtcaggagatcgagaccatcctggctaacacagtgaaaccccgtctccactaaaaatacaaaaaattagccgggcatggtggtgggcgcctgtggtcccagctgctctggaggctgaggcaggagaatggtgtgaacccgggaggcggagcttgcagtgagaaaaaaaaaaaaaagagtggtagctagagtctggactctgcagggtctcacacttgtaaaaaagtttacatgttattttaggtatgtagggaagtcactgtagaattctgagcagaaaaaatcagagatacatttttaaaggtccattttgtaacgatgggtatgccatcgcaagtatgggtggtaaacaataagttaaaagaggttgcaatggaaatttggactaatgttatgatagaaatgatttttagaaaacagtaagtcaggatgtaattgacatacagcaaaggtgatttgctcatgaatttaatagaagcaagagaaagggtgaagttggggtacatttgatttttgaaatgcgcagcttagtgaatggtgatgtatttaccaaggaaaagtagtgagatatatcattcaagagttcagctggattcaaagacataattgtggaactgagaagcacattaagtatatttacatgcaatggtttagatgagattgcttatagagtaagcataaatataagagaaaagagttaaggactgtgccctggtgtactctaacatttagagctaagaaaattaagaagaattggatgaaggttagtgaaatgggtggggaaggaagcagaagagagtggtatccagcagctaaaagattctgatgattcaaggagagtacaatggaatactattcatctatagaaaagaatgaaatattgccattcatggccacatggatggaactggaggatattatgctcagtgaaataagccaggaacagagttaaacgctgcatgttttcactcatatatggaagctaaacaaaattgatttcatagaagtaaaaagtaaaatggaaactggaaagattaggggggatagggagatggggagagagttgctaaaggatactaaattacagctagatagaaggaataagttctagggttttataaccctgcaggatgactataattaataataatatatagattcaggtagctagaaggagaataatgtccccaacacaaggaaatgataaatgtttgaggtgacagatatgctaatttctctgatctgataactatatattagatgtattgaaacatcactaggtactccatgaatatgtgcaattattatttgtcaattaaaaaataaaatatttttaaaaagaagaagcacacaattaactatgtcaaatgctgctgataattaagatgagaaccatgaaattactgctgggcccagtgatgtggaggtattgtattttaaaataaacaaataataattatatatatttatggggtacaatgtaatattttggtgcaggtctacattttggaatgattaaatcaagctaattaacatatccatcccctcacatcatttttttgtggtgagattaaagtctattcttttagaaatttgaaaatatacaacacattattattaactatggtcattaagctatgaatagagtactaaagtttattgctcttctctgctaaactttgtaaccttttggccaacttttcccttttccccatgccaacccccaggcttccagcctctggtaatcaccactctactctctacttctgtgagttcaactttttagattccacatataagtgagattatgcaatatttatctttctgtgcctgacttatttcacttagcatcattacctccaggtgcatctataatgttacaaatgacagaatttcctttttaagtccctatagcattccactctatgtagatacattttcttttctttttccttttcttttcttcctttttctgtgagacagagtctggctctgtcgcccaggctggagggcagtggcgcaatctcagctcagtgcaatctccacctcccaggtttaaatgattctcatacctgagccaaccaagtggtagctgggattacaggtgtgtgccactatgcccagctaatttttgatggggtcttgctatgttggccaggctggtcttgaacttctactctcaagtgacccgcctacatccatattttctttatccatccatctattgatgagcacttagattgatccatgtcttgcccattgtgaataatgccttagtgaacatgggagcaactttttctttggcgtagtaattttaattactatggatatacattcacaagtgggattattagatcatacggtagttctatgtttagtttttacatgaatctccatactgttttccataatgactgcattaatttacattctcaccatgaatgtaccagggttcccttttcttcacatcctcaccaacgtttgttctctttctccaaagaagacatagaaatgtccagatatatgaaaaacactcaatatcactactcatcagggaaattcaaattaaaagcacaataagatatccctcacacctgttaaagtgaactatcaaaaagtggaggtcttttatgacctacacttgagggataacagatgaatggtgtgtataatgaactgactgagattcaaagaatttgtgaaaatggaaatttagaggaacatacataactttcaacttatttgtgaagtgaacttatatcaaaggaaattcgggggtcaagaataatggttttaagatgagaaatatggcttatctaaacgctgctgtcaatgttctagtaagaagggggaaattgatcatgcaagagagaaagagacaactgcaagagtgaagccttggaaaaaatacatgtgatggaaccaagtggcctgtgcagcataggtagtttatctaaggtgacagaagagcaggcagcaaagagctatggattaaagtaagtggtaggcatattggtaaaagaatggaaattattttcccattcacttgtattttcacagtgattgaaaaacaatatcattcgctgaggatgtgaaaagcagaggtaggattacccagtgaggtgggagagaaatgaaagagcattgcatggtaacactgaggacacatctgagggtttttgtcttgaattttgtatgacaacagtaaacatggttctctgtttttctcatttagagtctagaatgcagtcatatgtaagtgaagaactgagtgagttcaatgaatgaaaagaggaagaagagagttaaggatggatgaaagaaacctaagctaggtaaggaagaccatgaggaatgacaatccaaaggtggtaaaccccactgcaggacaaagtccaaataattattagagctgggtaactaggagaaccagagataggaaattaagagcttataaacagggaatgggatgcttgaaattgagattttggaaatgatacaattattggtactgataaaatctaggttatgatcttgaagtgggtggctgaggtgaaaaaagagggacttttcagcagtttggaaatttgggaactggcatattattggatgcaccatctacaaatatagtgaaatcataagaatgatgacaaggatgtcagcaacttaacatacaaattatcatcctccccctccttaggcctaggctcacaaactggcttgctgtctctcttcacacctaaccacttcacccaatcccctctatatccacacctccacagcttcttcctggagttggacacctgttgctggaatatgcctcacacttacaaaactggaggcttaatattcacgaagaagaaagttatcatcaagggtcaactttagatgaagttcctgatggagctgcaaggccatgcacaaataaattacccattttcttttgtgcaactcatgagactgttcttttaggaccaaggaatttatttccctactcagaaaaggaaaagtatagcaaaccaattaaatggacaggttttaatgaaggcttcaggcagaaagataacaatccaaagttaaaaatttcaaatccatagacatcaactaaacaatcaagcacatcatctgatattgaagttgaagtgaaaggaactaatgattaaaaggaagatattgaccatgaagaaaaaggcagcaaaaaggatatgactaaagtaattgacagaaccactctgagagcttccagaatagaaagacagaaaacaagtagaaaatgaggatgcaggagttgtgaaaacatctcttaatctaaaaatgaatcaaaaacaggcaaaactgcaactacataagtcaaggctccaaaatcaaaggcaaacctgaaatagtgaatggtctgtccttcagagagcagcatggcaagtgaggaagataaaaataagaaaaaaaaggtcaagagaaaagcagcttaagggataaagagggcagaaggaagaagaaaagccaagaaaaagctcaaataaaggaagaaagaagttgaataataagtgacaaaattacctcagcaagaattatctcaacatctgattctgaaggagaaagagacgatcaagaaggtgaaaaaattagaaaaagagaaaagatgaaaaaatattcgggctattcacagatgtaatattctgataggccaacataagaaagaagcagcatctataaaacatatgcaataggaacaaatggaaactgtgcagcaaaataaagacaaaggaagaagccagaagaacaagaagtatcaatggagtctcagcttccaaggatacatgactacatgaaaaactcactcaagattggcagtcttgatgggaacagatatatcgaagcaacaatacaggcaacaagttcaaaatcacagagagattatgagaacacaaaagaaatataacaagtcaaagttagtcaggtacttatgaaaaagtctacaatatttgagacagacatacctgggagatattaacagttccagtacctgggaggtattaacagttgcagggcagggcacagtggctcatgcctgtaatcccagcactttgtgagaccgaagcaggtggatcacctgaggccaggagtttgaggccagcatggccaacatggtgaaaccctgtctctactaaaaatacaaaaattagccaggtgtggtggcacacgtgtgtagtcccagctactcgggaggctgagacaggagaatcgctcgaacccaggaagcggaggttgcagtgagccaagattgtgccactgcacatcagcctgagtgacagagcaagactccatctcaaaaaaaaagttccagttccagaccactgcaataaatccaatatcgaaataagcgaatcacgtgaaagttttggttgaccagtgcatgtaaaagttatgtctaaaatatgtatacaaacttttatgtctaaaatatgtatacacttttatgaaaaaataccttattgctaaaaaatgctaacgattatctgagtcttcaagtcacaatcctttggttagtggagtgtcatgcctccatgttgatggctgctgagtaatcagggtggtggttctgaaggttggggtggctgtggcaatttcttaaaaaaagacagtgaagtttacacactgattcttcctttcatgaaatagtgctttgtaacatagcatgctgtttggcagcattttacccaaagtagaacttctttcaaaattggagttaattttctcacatcctgccactgctttattaactaagtctatgtaatattgtaaatcctttgttatcattttagcaatgttcacagtatcttcactaggggtagattctgtcttaagaaattatattatttgcttatctgtaataaacagctcttcatccattcaagttttatcatgagattgcagcaattcactcacatgttcaggctccatttctaattcttgcgctgtttttatttccattacatccacagttacttcctccactgaagtctttaactcctcacagtcatctatgagggtcggaataaacttctttcaaattcctgctaatgttgatattttgacctgctcctatgagtcacaaatgttcttaatggcatctagaatggtgaatattttccagaaggttttcaatttacttcacccaggtccatcagaggaatcacactctatagccactataggcttacaaaacgtatttcttacataacaagacttgaacaaagtcaaaactgctccttgatctatgggctggagatggatgttatcaggcatgaaaacagtattaatctccttgtgcacctcccccagagctctcaggtaaccaggtgcattgtcaatgagcagtaacattttgagagaaatgtttttgtccgggtaatgtctcaacagtgggattaaaatagttaggaaatcatgctgtaaacagatgtgctgtcacctaggctttgttgttccatttacagagcacaggcagagtagattttacttaattcttaaaagcctaggattttcagaatggtcaatgagcatcagcttcaacttaaagtcaccagttcattagcccctaacaaaagagtcagcctgtcctttgaagctttgaagccaggcattgacttttcctctctggctatgaaagtcctcgatggcattttcttctaatataaggctgttttgtctacattgaaaatctgttgtttggtgcagctgccatcaatgatgttaggtagatcttctggataatttgctgcagcttctacatcagcatttgctgcttctccttgtattttatgttctggagatggcttcttttcctaaacctcatgactcaacctttgttagcttcaaactttttttctacagcttcatctctctcacagaattgaagaaagttttagggccttgctctggattagattttggcttaagggaatgtttgactggtttgatcttctatccagatcactaaaactctctccctgtcagcaataaggctgttacactttcttttcatttgtgtcttccttggagtagcacttttagtttccttcaagaactcttcctttaaattcataacttggctgtttggcacaagaagcctagctttcagccaatctcagcttttgacattctttcctcactaagcttaatcatttctagcttttgaattaaaatgataaatatgccactcttcctttctcttgaacactgagaggtcattgtcaggttattaattggtctaatttctataccattgtgtctgagggaatacagaggccaggaagaagaggagagatgaggaaacggctggtcagtgggactgtcagaacacacacatttttcaattaagttcgctgtctcatatgggtgcagttcaccatgccccaaagccattataatagcagcctcatacaatcactgaaaacagatcatcataacaaatacaataatagtgaaaaagtttgaaatacttcaaaaattaccaaaatgtgatacagagacatgaagtgagtgcaagttgttggagaaacgtagcaggttgacttgctccatgcagagttgtcacaaaccttgtattagttaaaaaaaaaaaaagtgatatctgcgaagtgcaataaagtgaagcagaagaaaacaagttatgcctgtagaaattttaagaatgtattggttggtgaaggatttcctgtgattacacaagtgctgaataaatccttcactaaacatagtcagcatgaggaagccaataaaaacaaagattggggtgagaaaagtacaaacaaaaaggaagaggaaggaataggttgaagggctttaaacagaggatctgatgccaagataacagtcagccacagcatagcataatggagacagcaacgaaacaagcaaagacaagcatgaggtcagccccacagaaaggcccactggtgagagagaccggaaaatcttggaaggagtttgcactggataattaagaaaatggacttggaatataaagaatatctgggaagttttcaatggttttcattggaaatatttaaactgtccgaagttttaaattttataagtgtaggttttgatatctaaaatttactttgaggaaaaaaaactcatctttgtttaaaggcaatcaaatgttattgttaatggtacttgttaagtattagcagttatgtaaaacactaaatgtggaaaaaatccatctagaaaatgcttttctagacagtatggttgtagcttattttcagtggatgtgtgtatgttaatgtgtagtggataatagaaaaaaagttaatttttaaaacactgctacttatataaactcttcctcttttccaaatacaatacatattgtgcatagtttgtacaagtcttggaattaccagaatgtctcttcactgtcagttttgtggaagttgagcatttttatgataaataaatattactttaataaaaatatttaaaataatgtataagacaaaactaagaaatttagttatcttacgtggtttcttttcccatgtaccataaaaatatatttcttacttctcattatgcaagtcaatacacgcaagacactatcgaaatgttcaaacattctgataacagttcatgaaaatgtctatgaagtgtgggatgacccactcactaatttaaggctatgaaataagtcacagttaaataaaacaatgaaatattttaaatttcttcaatatagcaatatatgacaaaataacctgaatatgttatccttttacattttttctttgggtttgacaaagaacccaattctttacttttaaaaaccttgaatgattagtattctggtcatttgttttttaaaagcctcatgggctgagtgtatccacttaattttctgtgtcagaccaaataattgcttttttgtttcctattttctttcctatataaaaagaataaaggcctgactgcttacaacacaatacatgtaggtggttataatgattaattataaaatgaaatactcaagataggtagttggtgctgtgcataccaggggtataatagatattccccagcccctgtgtaacagggctctggccaggcaaagtgatgttgttagcagtggccaattcatatatgtctgggtctgtggcaacctcaattctcaccttctcagaagaaagaaattgactgaggggcataaggcagaaggagagaccaaggcaaattttagagcaggtgtgaacatttattaaaaagctttagagtaggaatgaaaggaagtcaagtacatttggaagagtgtcaagtgggagacttgagagatcaagagcactgtttgacctttaacttggggttttatatgtaggcatgcttctggggtcttgtgttccttctgattcttcccttgggctgcgctgtcctgttcgtgtgcgcagtggcctgctaacacttgggaggggccacaagcgcagtgtgtttattggaggtgtacacacgctcacttgacacgttcttcccttaccagtcaaatgctccattttgcttcttagtgcgagtgcttgagccgctcacccaactcctgagatcttatcaagaaactgctgatcaccagtttcaggatttttctatctgttgggagactgcctttccctggtccagctgtgactaattactattttagagagatcattaacaactgcctgaccatcacctgaaggtcacctgacattgctggtgtgtgtgtgtgtcgggatggggggagcctttttctgccctgctcatgtctgaccaactacctaccttaacaatgtatgctatatctaggttgactcccaaactagcaagtcctccagattctcagtcttcctttgctgattaactaaatgcagaaaatctcactgtgacacattgaactgtgaaatgagggagaaatgatactttgtcattttaatccacttatatttttgagtcattggttacaatagccagcattactcatcttgacccagctatatctgaatctaaatcctggttacacctttctgtcattagtcaagaaatttaacttttcgagacttagatttctcatctataatacttggataataatacttgtttgagattatgatgaataaatgagatgttttctacaatgcctgtcaaagaatagaattgtcatttggcacttattatttctaaatctggtttctaatttaatcctctaagtattaccatttttcttaaaaccatgactaacacatttacaaaattaattatttacttatttgccataataagccaaaggtactactaaaatatttaaagctttttagggaaagtggtttttcctactcaacatcaattcatgatattgactgcagggcttctctagaacttatattcttgtatgatgtccattctgtaactatttctttctttctttttttttttttttttgagacagagtctcgctctgttgcccaggctggagtgcagtggcatgatctcggctcaatgcaacctccgcctcctgggttcaagcaattctcctgcctcagcctcccgagtagctgggactacaggtgcctgccaccacgctgggctaattttttttgtatttttagtaaagacggggtttcaccatattggccaggcctggtcttgagctcctgaccttgtgatccgcctgccttggtgtcccaaaatgctaggattacagacgtgagccatggcacccagccaagtatttctttccaatctttagtctccaattcattgatgtgaagttgcatgaccttcaaggcaatgtgatgttgcaaaattatttatcaaatgtattactaaaattaccttctcaaaaattttgccctcttgaaaatattttacagtggcattatctatgccacctgactcgtcagcaacattaaaaactttacgtactaatacattgttaacacacaggactatgacaaaagtctcatcagatacattgtttttttcccgctcttcaactttagctgttggaagagggatttcaggtacccagcccatcctctcacttaacaaagcagtcttctggatgtctctgtcaaaacttaaagtataataaaaataataaaaaaaaaaaaagaaaatgtggcacatatacaccatggaatactatgcagccataaaaaatgatgagttcatgtcctttgtagggacatagatgaaattggaaatcatcattctcagtaaactattgcaaggacagaaaaccaaacaccgcatgttctcactcatagatgggaattgaacaatgagaacacatggacacaggaaggggaacatcacattctgggtactgttgtggggtggggggaggggggagggatagcattaggagatatacctaatgctaaatgacaagttaatgggtgcagcccaccagcatggcacatgtatacatatgtaactaacctgcacattgtgcacatgtaccctaaaacttaaagtataatttaaaaaaatcctcataaacattaaattaagaatgaaatgcaaaaaaaaaaaaaataggtcacatagcctcttgttaagtcctgctggtgagggtaaggctcacaagatcacctattctgcttttttaaagttttatctgcctagggaaaaaaatctaaatatttcaacatctgccttcctgaaaaatccatcattggcctttgttgtgatctctggagcaaataaagcaggtctattctctattactctcatgaatttttaaagtgctgctgaaggtggaatttgttattggaattcatatacatttaatataacccgaggcaggaacctagcaggaagtagctggagctagtaattgaaaagttgcaaggacaccaaacagcttctttctgtacacgatcttcattcttttctattttctattttctaattctctcctcaggctacttagcagcaaagaaaggcttcatgttctgagacagaatacgattgtcgcctcttaggtgtccatctcttgtctagttagctgtgcttaactggactacaaggtggtggagttatactttcataggtgggaaagtattaaagcaggactctttttgatctttgcaaatacccatgaaagagaagtacagtgctttaatgatattaagtcattaaatttagccctcccactttcctaacattctcagccttatcttctctaggtatttcacataatcttgaaaatgcacaggttcaaaacatgtcaccaactgagtacctacttctagaaactcaacagttggtcaatgtttctgaaatgatgttctgtcatgacaagggaggaaatgcctcccatctcaatttaataccaatattaatagatgtaaatataattatagatcttatctcaaatttattttatcataatatcctatgttgaaagtaccattttaagggacaatctattactactctactcacttgtagtcactatacattgttctcatctatcatttatctttctcttagttttggacacctaagttgtttctaggttttttacatttaaatctatgccacaatggatatctttgcacataaatgcctcttgggtggtagttcttttgtttgtttgtttgttttgttttttgtttttgttttgttttgtttgagacggagtctcactctgtcacccaggctggagcgcagtggcacgaccttggcttgctgcaaccttcacctcttgggttcaagcaattctcttgcctcagcctcccaagtagctagaattacaggcacttgccaccaagcccagctaatttttgtatttttagtagagacagggtttcaccatgttggccaggctagtctcaaactcctgacctcaggtgatccacctgcctcggcctcccaaagtgctaggattacaggcctgagccaccacacctggctgggtggtatttctttagcagagatgtaatataatgtaatctgatttaatgtgcatagtaaaataaaagaaaaaagaaaactagcaaccataagagaatttatggaatgtaagacataaaaatattttttaagtaaaattaatttgaatatttgccaaaagatgaaaaaagaagacaaaataaaaagaactagtgcagcaaagagccccaagtccatttaaaaacagattataaagttcgctgggaattatctttaaatttagaaatgtaaatgatacagatgattaggagttaatcacaataattatgtcaataatagtattataactagcaaaaagtatgagaaaacaactaaagagatataagcatattaaatcacacatctctcataatggacccaataaattatctaaaacttaaatgtgatgttataatttgcatattttatatcttagaagatattttgcaaattaatgtgtcttgaggatataagtattgaaaacaattttagtaatacctcaggcagttgcttttattatttggaattcaaggacatttacgcttaatatattttaaacgaaaaataggattaacaatgtaattctgcgttcaactttaattttatatccatttgtatgcatgtatttcccattcttctattggaatatgtgtagacagattcataaaatgatgtgcatttaacgctaataatagttattgctggtgtggattttgagagtgagagttatgtttttgtaattttttttttactttcttctttctacatttgtattgccttgatttttttatgaacatgcaacatttggaaagctttagtcattattctaaatgttattatttaaattcaatatacaaattactgacctttgtatcataaaaaccaaaagtaaaatataaaacagaaaacagtgaataatttagatgtatgttattttgcattaagaaggttatttaaagatacacagaatcatatcacttgagctgttaaaataagaaaagtagaatctactatatgtatggatttcattatgtatactttatatgcatatttttatatttatgtttgtgtatccatgtgggtataaaatattgagcagcatcctaagaactataaggcatttactatcatcttctgtagctcattctcttttatatcaaataattcatattggagcaaaactctttgaatataacaaatgtgaaaaagttttcagaatgttcatattttaaaccattttatataataccagcttcagtgaagcattgtaacaaacataaaaagaatgtcagcaaatacaagtaacttaagtttctaaaaccaactctataaataaaaaataaaaatagaatagcattccttgcaccatctccaaaaaattcctaccacggagccaatagactgtctatgctgcacaaaagtcctgcaggtttgggaaagcctccacaatcaatactttctttagtgttagaagaataagactgagagagagccttgaatacaccaaatggcaaatgcatatattttagttcaaccttaatccataaccgtcactgactcgttcatccaaattaggtcctgcacagtttcttccttttctttaaatatatttaaattttttatatatttttatatataatataatatatttataaattttttatatatttttatatataatttatatttataaattttttatatatttatatataatatatatttatatttatatatttatattatataaatatatattatgtatatattatttatatatataaatgtaaggttgtaattgtttcataaatatttactaagttagttttctctcatatcaaagtttgcatgtattataaattaagtttcttgagaacttgccttgattgtctttaaggcctttagaggatatatcttatgcttataaaatgaactaaggcttttggagagacccctatagattcctttcaatccaacgctaacatagctatggggttagctcatctcagtccacaccacataccactcaaacatcaacccacccacccagttcaagagatcttagagtgtctgaagccaatgaaagggattatcacccttattcccatgttggcagtgagggtctgaacacacctggagttacagagagatacccttcctggtaccaaaagtttgtatactagctatttttatgaaggttccacatgagatgcccacaagaaagacaattaacatagttctctggcattggcagtgttagacagtctcaggtgctggggcagtctgaacctgatatagttcccatgagctggggcagtttgaacactgatatagttcccatgagattgccttgtgctggtggtgggtggtactgctcacattgaatctggaattttctccatactgattctgtttatgttaacttagctctggctagcactgtgattatttatgagtctcaacatgatctcatcctcctcaagttcccagaggttgaagagggtcagaggaaggaggacatggggagagattgatcaacggggactaagttgtaggtagctagaaggaatcagttctggtgttctgtttcacagtagagtctactgtttcacagtagagtgactaaggttaactatattctatcgtgtatttcaaaatagctagaagagagggttttgaatgttcttaccacagtgaaatgagtcaatggatatactaactactctgattcaatcattacatcatgtatacttgtatccaaagtgtaccccatttataggaagtatcatatgtcaattataaacaaaatttacagaaagaccatgaaaccattaggtagcaatgggtggactagaaccataagccttttggaagcatctccaccaaccacaaacttgctaagtcagaagccaattgatgctcccagaaccttcctcagaatgagagatgtatatacacatatatgtgacttttaatacatatatatttaagcacatttatacaaacacatatgtgtgcatatatatatatacacacagatatttctatataattaaaagtaattataaaacaaaattgtcaacatcttaaaaaagtgaaaatactttattaaaagtctatctgccaactttgtgtcatgtattattaataaaaaagcttttaatacagacatataatatttcttctgtagaaaaaaaaagtgaaaattgacattttaaaaaccagcattcaattaagggttattggcatttaggcaaagataatccttctccaaaaaaaaagaggaaaaaaaaagaagaggaagaagaaaaaagaaatagcattttaataaggaaaaactatgactcagtgtcattttaataattgcatttcctcaataaatccaagaaagctcagggaacaaattcaaatgtaactactttattaaatcaaaatccagctgttaggaaaaacactgaatcagtataaaacttgcagcaaacccatacatttgaaagtcctatctcagtaaggaattacttattgaaatttttaaaatgacagtgcattttacttttctggactgtttgcagagcactttaaacataattatcatagacttctggtttaatcttttgactttcatttcttctatgtcattatttaaacccaaatatattttgtaaatgaaatttttggtctcaacaggtctgctatatgtttgctgccatacagtctcttaaacaattttgaccctattaattaaacagttgttataaataatcaacagtctagattcaaaacacaatatggttgatgctatttttctgtaatagaaatatttttatatttgagctagttttgaaatatgtatttagccaaggtaggaaagtatgatcaaatgaaataaaaattaaaagctgtcagaaaatatgcaaattaattttgttgaaagtatataaagtagaagaaacaggaaggagattagaaattttcttatagatgtatatagttagattttaagtgaacttagattaatttcaaggatgttgctaattcaatcactttcatacatggtttgaatgttcagattatgttattttgtcccaataaatttcatgtcataaattctaattaaccacttttaagtaatcataatcaaatgcaaataaatctatttctttttgttgatttaccagtattatttttgaatttaaaacttgtttccaatatttaaactcttctgttcattattaaaatatgcttctcctttttcctaagacatagatcctcttgcatttcaaaaagtttcagagcttttctagctgcagattcctaggaggtcaggactacccttttctaccctttccttgtacccctctcctcagcatcctggcttcatggaaattttttgcttttgatttatttctttgtaaactatcggtaaaaaaggtgctgactgtcctgcctttctgaggcacacagtcttagtttatatgtagtgtaagtatatgtaaataagtgactagaacaatgttcatgaaaacaatttagttagagaaagaagacagaagaggaagcagaaggcagccctgagtgagtggtttcagcatctttggagggcagggtgtgttttctccaccaaaactaaatttcactaagaatgtgaatggagcacattcagaaaagaccattcagaaacgaacagaaatttgaactttttcagaagatagtagaattattgggacacgttttaaggagtgaggtgacttaatctgatttgcttttaaacatatctcactttgactacatcatggagtaaagttgggtaagggaggttgtgaaataattaattttaaataatattttttattattgttattgttttagaaagatttttaaagcatatgtttcaaccctggaagaactaatttttgcaaaacttgttaattcaagatttatataaataaagggtgaggtccctaactctacaacttcaaaaattcatatatgacatggtttggatttgtgtccctgcccaaatctcctgtcaaaattgtaattcccaaagttggaggaggggcctggtgggaggtgattagatcatgaggactgatatccccccttgctgtttttgagatagtaagtgagttctcacaagatctggttggttaacagtgtgtagcacctcccccttcactctgtcttcctcctgctccagccatgtaagatgggactccctcttcatcttctgccatgactgtaagtttcctgaggcctcccagccatgcttcttgtacaggctgtggaaccatgagccaattaaacctatttcctttataaattacccagtctcaggtagttcttgatagcaatgtgagaatggactaatatcataggtaataggtgtaacaggttaccagacaggagtaagaaaacttgatatataacctcagttctacatactatctcactgtgtaacatagaacaggcatttatcactctgagcttatgtgttttctaccatacaataaagaatccatctttttttttttttttttttttggcggagtcttgctgtgtctccaggctggagtacagtggtgtgatcttggctcactgcaacctctgcctcccaggttcaagcgattctcctgcctcagcctccctagtagctgggactactaatttttttgtatttttacacccagtttttttttttttttttttgtatttttagtagagacggggtttcaccatgttggccaggatagtctcgatctcttgacctcgtgatcctcctgcctctgccttccaaagtgctgagattacaggcgtgagccatcatgcccagccaaaatccagtatctttaaggcatagttctttgttgatatttagaatgccagagtatgtaatgagacatggtaaataagtgtagctaattgtgataaaatggctaaaaaaatgaggagtcaggtgaaaataatcttcagcatttattacttagggcccccaaattgtgctgaaaaaaagcccaaaactctgtgacgatctatcaagtattttttcttgtaagtgaccccatgtgctcctgctatcctggccatagataattggatcaaagtccaaagtaaactctaataaagtagatctcttgaatatgaaacacaaggagattttcatagataataaagaatcacagaagtaaagagacatcaaaaaagtatacaataaacagaatccataaaataagatacttaatacggagaaggagtgatacagtgagatattaattgcaggcattggaacatgaaccaaggcagaagcagaaataaaggaagaacagaagttgtaaattgcttcttaacaggagtagcaaggaagaataatcgttcatgaaatgacaaaatatatgatggctattttacaatacgcaagacataaagtggcaagatggggcattaagtagaggaagatatgaggtccaggtaatcagggaaactggtagtcatgaaaaaagagaagtcaatttactgaagagcagcattctaagagtcaggagaaaaataagccgaattctatgacatctatgatatcagacactactatgaattgaattttgacctccccaaatttatatttttaagccccaaatcccaatgtgactgtatttaaagacagggtctttgaaaggtaattaagattaaatgaggacgtaaagatgtggccctagtcccacagaattgatggtctcacaagaagaggaagagacacctgaggctcctaccctgtgcgcagagaaaaggccatgtgagaatacaaagagaaggaagccatctgcaagcccagaagagagccctttccagaaacggagtctgccggcaccttaatctaggacgtctaatctacagaactgtgggaaaacaaactttgctgtttaaaccatccagcctgtggtattttgttatggcaaccctagtaaaccaatacagaggctatgctgggttttcattcagattttagtatttgctttttactaaacaacaaaatgtgcttatatcaagcactgttctaataaaaaggaaatgataagagacttagatatggttcaaaaagcaatttagcggctgtcgcggtggctcacacctgtaatcccagcactttgggaggctgaggcgggcggatcatgaggtcgggagatcgagaccatcctggctaacacggtgaaaccccgtctgtactaaaaatacaaaaaattagccgggcgtggtggtgggcaggcgcctgtagttccagctagctactcgggaggctgaggcaggagaatggcgtgaacccaggaggcggagcttgcagatggccgagatggcaccactgcactccagcctgggcgactgagcgagactgcgtctaaaaaaaaaaaaaaaaaaaaaaaaaaaaaaaaaaaaaaaaagcaagcagatccatttcaaaagaaaattgttgattgacagtgcgcttacttcagagattagagctttcaattttagccatgatggtttccacattgtggcagagattacttccttttctattggtttattaatccattagttctcggttgaaaaattgcaagtatcttcaaattatgcattttcaacaaaacaattcaatataaatagtttcaaattaattatttcattggaataatcttagcctgcagtgattttcacttctgcaagactgagggaaccaatttaataggaaacctgatcaacagacctaccatatcaaatataggcaaatttctcagaaattcagttttaataaattataaatcaataaaacaaattccaagttcaccttaataatagaaaacatatatataaatatatggtctcaaggaatgatttaaattggtttctttctttgtaattttaagttggttcctttcccataactaacccttaagaaatcattatatactctacctttttgcttccgtctttttaatttttttggataaaattatttgtcaaggaaaattgatgtctattgaagattttgtggtttacaaataatttgtagtgtttaagtacctccattgtataaaatgagactgtcttaatatactcttacggtaataccacagacatttctcagtctttagctttcttccttctctaaaatctttcataaggaatttattttcaatgcaagaattcacaatctcattgaaataactgagtttctgttgtggaatgggaagtctgcctagaaaagaacacacaaaggcaaaaggcatcagaatcacagaatagagtatgttgctaaagagcccaattaggaagcaataattgtacattaaaactagagcattcatattgctcagaaattcagactcagaagtgctccagtttgtggcaacaacaagaaggccccagatcaaatatttctcctgtatgtccatgtttatcaaagacttcgtatcatcaaatatcaaaatgttttcttctcctttgcaattatccataaaatgtatatatagaaaacagtatttataaaacgcagaaatgtgggaagtactttgtcacagaatattattttcgaatgaaacatggctttgataataatagttaatataatttaatcccacttcataaatccctcttcttacatctttccttatgtttgtcaaaagtgaaactgaagaacatctataaaagtagttctttcccactattgtgattcaggtagaatttcgttctcaatcaaattagagcataattcctttcatgtaattgacagggggttttccccttatatagtaagggtttactttttttttcttaactccttctccactttataatttctgcctgaattataataaatttattttaaagaaattaatgctgtcttgaagtaaagtctgatgaatctgtatataagtaaattttaagaagtgaaagtttacattccttatacatctcatctctcctacagcagaggtagtgagttactgacttcaaaatctcctttttcttacgagattctcacattaatgttcaataccgtaagtcttttcaggattaattgtaaattcacaacattttctttaaatagccctaaggagacatatatcattttgtgtttatctatatatttatgttcttctaaaatgaataatcaatgaaatatgaatgaataaactagatgaatataaactccccactgaattatgttatgtgtccttctgaacacagtaaggaaagcattcacccaaagactctcctaatttgaattagttattttcagttttggggataagcacttttccaccattgttgaaacatagttttgattttctgaaagtgtacaaaatatttcaggaataaatgacattaacttgtggttatttcatgcctcaagaatagctgtaattatttcttctctggtagttcaataccctttcaacagctggctgaaaaaatcaattgcatcttgatttcaatttttcatcgtggtattttttaatggttagatttcaaaagaatgtgcttataatgaagaaaaatcatgctagtgtctagatttattctttcagctgatattaattaaataaaacaaagttagcattcatatgattttattgataagaatgagaaaataattagaaggcatccctgaatcaggcacccaggcatgatgcgatatgccttcgtatcggctctgcaatacttagctatttaacgtaaagcaagtatacacctctggatttttgtttgttcatttgcaaagaaagtggggatggagtacataatcttgaagaatgtttcatgtctaatattctatgcatttgaagtcagaaaattgaagagcataaactaaatttcatcactctgaaaacaagtcacatgaaatgagcctcatttgaacactcagagaacgtgccaaattacgaggctgaacactctatccgttgtggatgactcaatttacataacgtggaaggaaatcatctcagtaactttgtaggcatggccatgcgttgcttatttacatatggatcaagggtttcacgtatcacttagaagaaatggaaagaagtaggactgttagatatggaattctgtaagagccttccatatgtctattctgattcacttaacatgctgtgttatacctagcaaatgtaaaattaattcatgccttcagtggggtgtgtgtgtgtgtgtgtatgtgtgtgtgtatgataaaacctagaaaggtaatttagaagtgtgacactatgagtactcatattgaactttatttttttgctgctgacttcttaatctccaagaaaagatttgtgctttcaatgcatttttaaaccaaatcctcctgagacaagatcttcattctcaagcagctctgatcttccaccaagatattgggatgtaaaatcaaaataaataattcttggtttctaggatcagttagttatccactaaaaataccactctccttccatagtatggagctgtgactgcaaagtgactgctccgcctgtctataaatcccaaccactgctgggcacagtggtatgcgtataatcccatcattttgcggggccgaggcaggaagattgcttgaggccaggatttcgagaccatcctggacaacacagtgagaccccctctctaaaaaaataaaaaataaagaaacactaacttctttgctggggaattgtataatgggcatacagttctggccagtggactgtgaatgagaagtcaaatgtcacacttctaggctgacacaattgagaagtgagtttgccttgtctgttctctttttctatttgctagctgggagcaaaggactctaatgtcctaagagatggcaatatcacaaaagggaaagatgctggctccctgaatcatcaggttggaggcaggtgttacacattccactggactgtcacatgagtggaaaattaattgcactaaaccatgggaatgcttggtgttgtttttatagcattcagatttccttgtttcaaacactgtaggcaaaagcacatgaggaaggacttttcatattcatgtaaactattaaaagagcccaattgaatcaaggtatttagtttcaccaggcaaataacttactctagagagacttttcttattttcaaaattaattaaatgtgtttaaaaatactgtctttctaccccatactgacacagatttactcaatattatacctccgtttgtttccattatttaatttgctgtgcttaggggcaagccatggcaaggacaaaaattacttcaaaaaactcattcctcattcctgttaagtctacccctgaggcacccagttttctccctgtttgcagtttaatgactttcctgattcttagagtgcagtgggaggtattcccagtggagtagctgttgcagaagcaatcctacagtatctctaaggagatttctagtgagaagtgtgaaaatcagtgttcattaaaatgcatatttactgttttaaaagttattttcacatcacacaacaagatacaagtattaggtgccaggcatttcaaaaaagtttttgtctaaattttggtatatataattcagaaacttcttcagggaccttttccaactcattataacaacaagaaaacccaaaaatctcagttttaaaacaatttccttcagttacatctccattgtaattttagcttaatgatatgtagttatgttttccactttcacaatgctagcattacacagatgttcttttcagatggaaagcacagctgtccattatcattaacatttcatccgaatgcacaatgatataaattaagggaaagccttttacaaaataaaattgaagcttttttaaaaaaattctaggatatgaggttttggccttagtggcttcaaaacaatagtggctttagaattgttaggattttcatgtaaactttcatgttaggattttcatgttaggactttcatgtaaggaagaatcagagaagatttcaagaattgatttgtatataagcttaatgacttcacttttcaagattaaaatgtcaaaatagaatacataatttcatgagtataaattttgttgcagttattcttattttggtattgccaaataaaatagtcttaaacttaaatgcatttgtaaatacaattagattgagtgagtcaacttgtttaacattttctaagtactattatgtgtaattactatgttgagttaagaagcacaaattcttctgaaaatatgctgcaatgtttaaatattgtataagaagaaatacattcatgaatgatgtttgatggggcactggacttagtctgtttattgaatctatgtcctacaatttctgctccctctgcacaaaatgtatttcctttattttctacttctttatcaatgataaattttgtaccaacatctctcatatccatctatgaattaatatagagacacacgtaggtccttttccttcagcgttccttatctcacaatttaaatctacttgtacacttgatttcacatcacattctggggaaaatctcgtggctagcaaatgttaagggagctgtagacttaaaattggctctctatattcagccctgctggacttgtagcacaaagcactggcttctttattgttctttgtgagcagactacaagttcctatatcacgactcacaaaatatttcagttttgtcccttctgcatgaatcagatctcttatggctagtgactcaatcggactgaatttggggccctaccattcgagcaccagtttctacatataggaattttctgaataatactatcttttcttaaacactataccaacttctagggtctctcccatgatctcctgggtgttaggatgctgaactcagcaacctatttgggaacagaagaaaaagtcaagagaatggcagaaagcttgaccctgacattcctgatccccagaaccaacacaacagcctctccccacacagctcattgtgtgagaaaaaaccctgatgtgttaggttgtcgttctactgtgtctgctactaatagccaaccactattattaactgacactgtcctagaacatcttgctttcctctgagagctgacatactttctcccttttgataatgagaagaaaagattttaacgtcttactctgactgccacaaatcttagaggcacctttaatcactgtggttgtggcaatctttatcattggtttatatgttcctatatgcattcgtgactgtttttctcttcctacttccattctttttcttctccttctcctccttctccttcttcttcttcttcttcttcttctccttcttctcctttttttttctagagacaaggtcttgctctgtcacccaggttggagtgcagtggtgtgattgtagctcaccacagcctcaaactcccgtcttaaattgtcctccccacctcagcctcctaagtagctggaccacagccaggcaccacaatgactgactaatgtgtgtgggtgtgtgtgtgtgtgtgtctgtgtgtgtagataaggtcttgtgtacctaggctgtttttgaactcctggcctcaagccgtttttctacctctacttcccaacgtgctgtgattaccagaatgagccactgcaaccaactcctactttcattcttattctttctgaaaactccctataagtctatttgaaatgagaaaggacataggaatttaattttgaaatgtacttatgtgctgctcttcctaagaattatataaaattccccagacatgtaacttggtcatttttataatcagtcttattgatatcagatatcattaatatgtatatgtacatattatacaggtaataatacatgtcataacgtaagaaatacattgagcatgtaagtttcaacaggaccaaggctggatatcagggagagaggaggaaacaagacagtcatggacctaagactcatagtttatagaataaagtacaacttacaaatagtttgtttagtggctttacttttatcagttagaacacctaagtgaatatttaaatcaagatccaaggcaaggttactttaaattggtgctgagtatcaaatccttaaatccttgaaaaatgaaaatgaaagcctttctttttgttttttttttgcgaaaacatcagaagatataacatccacttttatcatgatttcttcttttatcttatttttgtctcatgaatgctaataattttggtgtagcttcagtgaactcatatctttaataatattcaatgccatattattccaaagacaaaaattggaaactgtatttactaaaggcattttaagggaaatatctgagttgatgatctacacggggtcagcattccctatgtaccttgttatttaaaatgttccctgaggtcaggaaaatatgcctaacagggataatttgttctccagagtagtaaaatgctacagttagaaaataggccagagacatcctagcttccctataaatatcaactgaattagtgcacaaataaaaatatagcatgctatagaaaactgcaggtcttccggaaccccaataaataaatataaagagccagaagttgtatcataaaactacataatgataatattgataaggacattgtcagtgcacttcagaatcctcaggttttttaaggatttaccaaacaaagattaaattgggattattaaaaagtcatgataaatcattcttaagaattttcaaaagtctatttatttatttgtttatttatgtatttatttatttttgagatggagttttgctcttgttgcccaggctgtagtacaatggcgtgatcttggctcaccgcaacctccaccttccaggttcaagctattctcctgcctcagcctcctgagtagttgggatcacaggcatgtgccaccacgcccagctaaagtcttttttttatttttagtagagatggggtttctccatgttggtcaggctggtctggagctcctgacctgaggtgatccacctaccttggcctcccaaagtgctgggattacaggtgtgagccactgcactggcttttcaaaagtctattttttacattggtaattcatgttgtaaatatttttaataaaccagaatatcagttccatactgtatctcattacctatttgtttcaaacatttacataaacttcaacaatatttacctaaagacgtctaagtcttatcaacaacttttttaatattaggcttttaaaaaaccatagtgaacatagttgttcctaaacagaggagagaaattacttgcatgaacatttgtccttctggggagatgaggcaagtattccatgacaatttcataggaagccacaaattatctgtccttgttgccacctttgcattctgctcagtagacacagcatctgttcagtcatttctagattgctgaggaatgtgcctacactaagtttgtagactagcatattctgcactctctcaattaggggatgaattagctgtggggagagcctccactttggatgcttgaatagaaaattgccgtgcatattaaactgtgggttggggatctatttcaatcctggaggacagagtatggaaaacatcctgtttggtgtattgtggtagaaagactatagagcctctgagatacccaaccttatttttaggactgctctaccacagaaaatggtgtggccatcccttaaataggatgtctcacctacattaggaaagtgatagaaaaaaaaaatgagatgtaataaggatataaggagagactgttaagttgcaaattgccctatgcatagcagctgtgcacaacagggctatccctcggaacgctatccttcactcaagggtggctgaggaaatgcacactttcttttttttcttgagacggagtctcgctctgtcacccaggctggaatgcaatggcacagtctcggctcacggcaacttccgcctcccaggttcaagcaattctcctgcctctgcctcctgagtagctgggattacaggtgcccgccaccaggcctggctgattttttgtatatttagtagagatggggtttcaccatgttggtcaggctggtctcgaactcctgaccttgtgatccacccgcctcagcctcccaaagtactgggattacaggcgtgagccaccgcacccagccagaaatgcacactttctaaatgagtattccctcctccatctcacagttccttgctaaatcttcaaataaatttgcctgagaagtttaaacattcatcatccaaccccttgctctctgtttttcacaaagtctcccttttctcctgccactaatatattccagataataaatgacccaagacatgctcatttagctggaacatggtagatgctgaccttaattcagttccgatatttcacaataattacaatcattccctttggtcagtgtaagaattctttaaagtataagaacatttagctcccaaatactgactgcccttttatgcctaaataaatggttgtcaactacgttttctttcttagtgagagttaaaattttataagacagatggtctcattagcctgagatacttgaagatatctacccttttcctaattaactggccattcatcattcttaaagcaatatcataatagagatggccaagatattccacatgcaaactccctgtatgagttactgctaatcagtttttacatacgatactgaagaatggggttctcagagattatatttgttcaaaaggagacaaataaaccattggtactagcattattccatttaaagattatcactcatttcttattcttttatttaagcagataatatggaataaatcccagagtttcactaaaagaggtagacaaaatattgtacaaagatatccaaagtgcaattgtgactttatgaccttagaggaagcctaccttgtagactttcagggaactgagaccattggtttctctatcaaggtctccattaaaaggcagacagactggctctcggaaaagctcctctgttattttgatttctttatgttactgcctcctgcatagaaaactcgctccctcttttgactgtgagaattatgtctttgaatgctaaacaggtatcatctgtagaatttgaatatcctggaacaatttctttaataggtaccctcatggggcaggaggtaaaaaaaaaaaaaaaaaagcaaaggaaaaatgatggtatataaaaaatgatcctcttcagagggaatcaagttcagatataaccttgaacataaaaatatgagttcattcaaattaacagcactttccactgttgcgtttttagtatgctaatatccgtccaaatcactttatgaaaaacaaaggagcatttccacttagataagtcaaatctgctgtgtttgtagaacttccagatagttaattatatctagatttagctatgctcttttaaatattgtatgcacaataacatgaaattagcagaaagtgactaatccatccagccaattaagtctacccagatgctgcacttttgcatctgaagttactttggaaaaaaactgggacagaaatattaaactagggaataatattttgttgaatattacgtatgggataaaatccatgttagattactcaaacccaaaccatttatatcagtataatatccagtcagacaaaagattgttttgtctaaagtatctattgttttgcacttaagtgtggtcatatgtaaaatctttatttgagcttttgaaacaataataagaaataaccgtttgtttcagcaaattacagactccattctattatctgtgcacatacttcaacatttctacttcctaataggatcagtatcctctcagcaggccaaactatgcctgacatagcaattgaagttaaaatttactttgataattacaatccttattttatttcatatgaatacacatatgcaaaaaaaggaaatgatcctttcaaatagcttacagtcaagaaaacatgaccctgtcactgactggcaagtgtacccgcagagactgcacccaatttcagaatcttgcagcagtgttgttaactagatccatgcctttcgcatggctatgagctttaatgggcaaggagcatataggactcaagaataaagagcactagatttcccagaggaaaacataattctaatagttactgaagaaagaaaaagatgaaatatggagaaagcaagttatgcagaaggcaagaacagagtgttcaactttgaaataatagagaataaactatcacagcaggttatggaaatgaaatctaacttgaagttgactgtcaaatacttatcagctaatcagtctgaaatgtaagttgttaacaagttcacattcaatgttttactactttcatagtttcctatcatttatattataaatttggtgtacctatttctggtactattagtgctaatacaaattatggacccaaaagaattttagaaagtgacattcttaaacagagttagatgaaatggagaagatggataataaaaatagcatgttttctaaaacggctacaaaccaggaaatatttttctattattttgaggataaagaatatactgtgatgattatgtctctaaaattaaagcttgtatcaatttcattgcaaaagtgttgaataagattcattgttgttgttgttttctctgaaacagtctcgctctatcgcccaggctggagtgcagtacagtgcgatctcagcacactgcagttcctgcctccagggtttaaggtattctcttgcctcagcctccagaggcactgggactacaagtacaccaccaccctgggataatttttgtatttttagtagagatggggtttcgccatgttggccaggctgttctcaaacgcctaacctcaagtgatctgccagcctcagcctcccaatgtgctgggattacaggcttgagccatccttactggatgagatttcttttaaatgctacattttttgagcaaaaggcaaggaggttagggaggggagaacagggaagacaggcagacagacaagcaggcatttcttattttctgaacaggttcctcattattttcaagtaatgtctatttgtgactactcattttcattattttatttatattttagtaagcaatgcatttatatctaaacatctaataaacattctactcatttgatacattttacaattatttaaccatatttcttcaaatttaatgtgtgtaatgcaaattgttttctctttctgatcaaaaactacacagtcattgtggaaattttgaaaaaaatatctggtactatgaagaaaaaaatcacctttaatgttatacccagttaagcagagaatataacaaagttaaagttggttctgtagaaagattaatgaaattggtataaaatccttagaaatacattcaaaatacaaaaaagagagaaaaattgttcaacattaggcatatgtgagggaacaaacattactataaatcttacaagtactaaatgtgctataaaagaatgttttgatagccttttttcaacaaatttcacactttccgtgacatagaaaattctctttgaaaataacattctagaattggcccaaaatgaagcaaaaaatcaaaaatattcccaccaagaaagctccatcttaggaggtatcactggtgagttctattaaatatttaagaaaaaaatgcttatcctgacaaaaaaaaaaaattaacaaaggaagaacttctcactgcattttatgagaccaacaccatcttgataacaaaaccaggaaacaactttgagtaagaaacagagaccactatttctcatgaacctgaaaaaacgtccctaataatattagcagatattgatttcagaattaagtggagtttgttccagaaatccaaggctgctttaaaagcaatcaaagtacttcatcatattaacagactaaaataaaagaaaaaatatatgattaatagataccaaaaaagtattaacaaacatgaagtaaaaaagaattttctcactatgataaagaggatctgcctacagcaaacgacatgcttaataatgaaacctaaacacatttgtcctaagaatgggaacaaagaaaggatgtctctgcaatactaaccagtgaaataagtccagaaaaagaaattaaaggtttacaggttagaaaggaaaaaacaaagctgaaattatttataaaagatataatcatagaaatagaaaattccaaagaatctacaaaaatactattagataaattaataaattcactttgctgaatgaatttagcaaagttgtagataaaaactaaatataaaaagtcatttgtatttttatatatcaattggaatttagaatggagacaacaccatttaaaatagcattaaatcttgaaatatttgatttcaagattttaaagcaaattttacaaaatagatgcaaaatatatacacttaaaactgcaaatattgctgagaggaattgaccaaaacctagttaaataagtaagagataactatagttatagatttggagtcaaaattgtttgttgtcaattcttagtttattaatcaatagatttataaaaactcgaatcaatatcccgacaggctttctttatagatattgataagttgaattttaaatagaaatgcaaaagatccagcataaccaaaataatgtttaaaagaacaagagttgaatgatatatatattacctgatttcaggttttactataaaattatagtaatcaaggtaatgttggtataggtaaaaatatattcaaagaaatcaatggaagtatggaaatcacagaaatagatccagatgttcattcatggtatatagctttttgacaaaaggtgccaacgtatttcaatggagaaagaatagccttttaaacaaattgtgttagagcaactgaatattcatttgaataaggaaaaaaaggaatatcataccttgcctcaaatcatgctaaaaattaactctaaatagattgtatacttaactgtaaaaggcaaaacgattaaacttttagaaacataggataactttacaaacttcgggtaggcaaaaatttattaggtcaaaaaaattacaaactgtgaaaaaaaccagataaattgtacttcaaaaacattttaaatttctgatcttcataacacactatttagaaagtgaaaagacaaccccaaacaggaaaatattcataatgcatgtacctggcaaagaatgaggctttagaatatataaataactcatctcaataataagaagatgaaaacatttaaaagtacaaaagatttgagctgatgcttcactaaatacgttattgaaatgaccaatgagtatatgaaaaggtgcacagcagtttagtcatcaatgaactagaaactccatcaatgaaataccacgcactctaggatggctaaaattaaaaagactgaaaatgccaagagtttttgaagatttggagcaactggtaacactcagacattgctggtgggaatgtaaatgtgtttggcagtttaatatcaactatgcatatgcttcctataaagtagtgaaaatcatctgttcatacaaataattatagacacatattaagaacaggtatgcttattatagcagaaactgaaaataacacaaaatccatcaacaagtaaatggataaaaatatttttgataaatacggataataaaataatactattaaaaataaatacagggccgggcacggtggcttacgcctgtaatcccaacactttgggaggctgaggcaggtggatcacgtggtcaagagattgttaccatcaaggccaatatggtgaaactctgtctctaccaaaaaaagatacaaaaattaactggacatggtggcacgtgcctgtagtcccagctactcgggaagctgaggcaggagaattgcttgaacccaggaggcggaagttacaatgagctgagatcacatcattgcactccagcctcgacaacaagagcaaaactctgtctcaaaaaataaaataaaataaatacaaactaactgctaagatgtcacaacatggttgcatcttaacaacattgtgcagagccaaataaaccagatactcaaaagtagatatggcatgatttcatttatattaaattctagaacaggttacaatgaatctacagttatagaaagcatatcagggttgtatgaaactagtcaagtaagaggactggtgcaaagaggcaaaaggcaaccattaaggtgatgaaaacattctgttttaattttagttgtggttacagtaacatgaatttttcataactcgaactgtacatttttaaaatgcatgcattttatatgtgttatacatgaacacaaatgatatttttttttttttttttgagacggagtctcgctccgtcgcccaggctggagtgcagtggcgggatctcggctcactgcaagctccgcctcccgggttcacgccattctcctgcctcagcctcccgagtagctgggactacaggcacccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccagcccacaaatgatatttttaagaagcaaacaatctaacaggaaggaattgagcagatttttcagaaatgaaggtattcaagtggccaataattacattaaaaagtacacaatatcatccacaataatgaaagaaaggcaaattaagcccacgagatatcactacatgcccatacaaatgagttaaaatctgaaaacaataaatgctagtgcatggagcaactgggactcttgtatattgcagggattataaaaatttccaaatgctttggaaaaccatttggtagtgtcgaaataataacattacgatacaactactatgtgatttagcaatttcactgctccatatttccaaagcaaatataaaaactaggtccaccaaaaaaaaaactggcaaaggaatacttatgtttaaactgtccaaaatcttcataaatctggagaataagtagaaaattttcatgtattcataaaatggaatatatttcagcaataagaatcctgaggtacataacaagacaggtgaatctcaaaagatttttaaaaggacaggtaaaactaatatatagcaacagaaattcagcagtggttggctctggctggtgggccttgactgtaagtggataataggaactttgtgggataatgaaaatatttatgttgattgggatggtagctatacatatgaatgcacttttctattcacgaaaccatgcccttaacatctgtgcacttagatcacctaacagtattttaactctattgaaaaatatgcaagtactgtgtaaagaaaatatacgtaattttaggtcttgggtgaataaaagacataacagggacaggtataccaaacttcataaagatagcaattatccataatttaatttataaagtttacaaaactacaatagtctagcgcgactacatatttgatagcacagtataacccattaatcatcaaaaaaatgcgatatcagtgatataagagtcagacaatggcataatagaaaatctcaaaataggcacaaatatgtgaaaacttagcatacaataatcttgccatttaaaatgaatgagggaaatagacttttcaataaataatggtgcagtaactggttaaccacctggaaaataaatgtatatttatatttcataaattttaccagaatcaatctctgtttacagatttaatgtaacctatgaaaatataaaaaaactagaagaaatcatgacacgttccttaacctaaaattacgaaaggcttttctaaaaataacatcaaatctataatagaaaagatcgatacatttaagtacaaatatatgttccatttaaacataatttttttaaaaatcaaaagacaaatggaaaatgaagatgggataaggaaataattatttgaaaaacacatggttcacaaataagcaaatacatacaggcttttatacatttaaaaattatctcataataaggtaagcttaaattaaaactacattgaggctgggtgtggtggctcatgcctgtaatcccagcactttgggaggccgaggtgggcgactcacttcaggtcaggagttcgagaccagcctggccaatataataaaactccatctctactaaaaatacaaaaaaaaaaaaaaaaattagccagctgtggtggttcatgcctgtagtcccagctgctcgcaaggctacagcactagaatctcttgaacccaggaggcagaggttgcggtgagcggagatcatgccactctactccagcctgggcgacagagtaagactccatctcaaacaaacaaacaaataaacaaactacattgatatatcagttttcaattagtatatttggaaagattctcaaatttgattgcacatcaacagagatgtttgtaaaaggcatttttatatctgactagaaaagatataaattgatataatctgtatcaaaggcaatatagcaacatttaccaaaattgtggaagcaattaacttttgacttggcaatatcaattctaagaattatcttaaagatgtaacacttatgtaatgttgcatacgtacatgttatacttgggtcccagtgtgacattcttccaaaatacttatttttgttctgcccctcaacttttgttctgcccctcaatctaagactgtacagaggagaagccagctcagaagagatacaattaacctgtcctctttcttcagtctattttgaaacaaaatgaaaaattattttcagtacgctcaataagagaatcatgcttaccttgtattcacccactgggaaataaaagcaaatatatttttaaaataataatatctatctatctacttatctatccatgtatctttcactttcatattacgctcttacagatacgatgctttagagttgctatatgtctttaattacacaatttgagatatttaaaaaaataagcctctgaataatactataatatctatagcatgaatgagtaagctgagttagaaagttgaaatgagttacctatagatgtataactaactaagttgacgactttggaattaaagtatgttttatgactccaagtcaggagatacttctacacaaatttcatgacaatgatctcaaatccatttcaggctgaattatctcagttacctatatcttaattgtttacttaaaaatactgacaatatatgtatgtacatatgtttttttcctcaaaactcttttctcgaagatttcaagataaaagtatgaagctgacatcttcagggcactaatcaaataaacaaagattgtaatttgccaagtcttatagtatggcctaattttactaaaacaaacaaaaaacaagaacagtgaccagttttctaattttagatccaatctaaatgcaataacctgatcaacaatagtagtatcaatcttctcttttctttgtcttcaaaagggtgtatcattttgataagcaaatgatataaaccaactttttcattagctacagtatttgttttgatcctctttcaaatgaggaaacatacctatatgtagccaaaaataacagattgctcttatacaggaaaagcaattgatggttgttttttaaccttttctgataattctctatgaccaaagatgttaaaatagagactttataaaacaggaaatttcatcaaattttctggttgttagatatcaataacttcattttatataaattaacaatttgaaatgtgtgtctcttctagagtctaccatatatagtcaagtactcccaaaaagaaagtggtgataaaattgtttgattactaatgtctgtattgtttaattagcaggtgattaaacaatgtgtagggaaaacgtcattgaatagactggcatctgaatgcaaagaagcaattacatgagcttactactcaagtccttactatagagaaaatgcttttgtttgtttaaatttctctgaaggatgaatatgactgacaactctgtttttgaagttataagtcctttttcgtttctcatcggagatgcattccatagtaacatactggcattcatcaatcctatgttttaaagatttcctttgtgcctctaagagtttggtggtgcagagggtaattgcaactgaagagacaggcaatgcagtaaaataataagaggcctaaaaatttaggtataattttcagtctcaggatctcacctgaaagcaccactgtaccttttattgtcaatattagccattttattttctgcagtttctatgaactccttacagataaagaaaccaaactttaaaaatattcctcaaagatctaaagacagaaataccgttcaacccagcaatcctattaccgggattatatacacccaaagaaatattaatcattctaaaaatacaaaaaattagccaggtgtggtggcacacgcctgtgatcccaactacttgggaggctagggcaggagaatcgcttgaacctgggaggcggaggttgcagtgagccaagatcacaccactgcactccagcctgggcaacagagcgagacttcttctcaaaaaaaaaaaaagaatcattctattataaagacatatgcacatgtatattcattgcaacactattctcaatagcaaagacatggaattaacctaaatgcccatcaatgatagattggataaagaaaatatggtacatatataccatgggaatactatgtagccataaaaaagaacgagatcatatcttttgcaagaatatgaatggaactggaggtcactatccctagcaaactaacacgggagcagaaaaccaaatactgtacatgttctcacttgtatgttggagctaaatgatgagaacacattgacacatacaggggaacaacacacaatggggcctactagaaggtagaaagtaggaggagggagaagataaggaaaaaataactaatgggaatacctgggtgatgaaataatctgtacagcaaaccccatgacacaagtttacctatgtaacaaggcttcacatgtatccctgaacttaaaataaaagttaaaaaatattctaaactttgattactattgtaaatgagaaataaaattctaagtccctcaagtgactgaatggaccttccttctggccaagggggtcccaaagaaacctgagaaactactttaggccatgatgagaagtgtcagcccaggcatgcctcattgtaccctctctttggagtttaggcacaactgacaagcattaacattaaaatagaaataagactcacaaaacagattctttgtggcaatgatacccaccttcaacctgaccctggtatagcataacatggtctgaaggaaatcaaagtactttaccccaaaatatattttctttgacatattttgaagtgggcctgcaaagctgtgtcttgtgggggaaacttgtattctgtaaagaaattccttcccttactaggtcttttccagagagtctgtcaccttgtaaggtccaataagagaaaattaccatctattctctctgaagcctattacttaaaggtttcatgtatataacaagaaccttggcttccacaacccccttatcttaactcaatcatttctttctgctgacttcaactcttcaggaaaagcttaactctttcaatggccaatcaggaattctttgaatcctcctttccgggacaaacaaatgtataccttacatgtattgatttatgtctttgcctgtaacttctcttcccctaaaatgtgtaaagccaaaagctgtaacccaaccaccttggccacatgttctcaggaccttgtgaggctgtgtcacagactatggtcactcaaatttgaggctcagaataaatatcttcgaatattttacagagtttggttttattcatcaacactatttcccaattccaaggtataaagtgattgagaatcatgaatttaacagctttagagtatccttgaatccatacagggaaaaaaataatatcatgcattgccctctgaaagctgagcagagcccacttaatgctctggttaaataaagccaagggttcagtttccaaaaacaaaataagttatattgctaaaaaaagaaaccacttttgtttgagaagctttataaacaatattttgcaaacatttcctctctattggggcagacaattgaatgtctatttgctgaagttaaagcaatctgaaattcaatttgttggctatggagctactttaggaccaagtaagcaaatacctttaggctaggataaagatttatttcagtgtgcatccagccaactcattttcttactcttggcacaatgcagttttagattaattttctgagaataactgggatgtaaaaattaatttatgcagttcttgaattgactgtgtcaatctgaaaataaatggcctacttttctttgttaaaatctttacaaatctatacaatagaaggcattcattggttactgggtaggtgacaaatcccttgggaaatttagaaaaatcttagagagacaaaaaaaaaatgtgacttttcaaaataagtaatgaagttttaaacattcaaaagagataaatttgattgttattttaaagccgggagtgacaaagtcttatcaatttttcagctttgtttaggttttcattagaaataaacaacttttattttaaataaaaaattaaactgagacattaaaactttattccatgatagattttagtattttattccagtatttgttgtcttgcttgtttaatgtggccacttggaatctgctaacaagagaggtcagaagagaagatcaatattactgggatacatggaaaaatgaaatcaagctaaaatagggatattactgcatgaaagccttagagtagaaacaaggagaaaaagaaggagaaagcaaggcaaaatcagcaagaatgattcaaattggacctctaggtttctgctctgtgagaattgttctatcagaagtatgtagggaaggaagagatattgcacttgttagagtaggtagctaggcagagatgggcagggtaggagaccccctctcccctcaaggaatgtcatgagaccctcaggtgatggtccggtggttattaaacggtctctctgaaacgatatttcgttgcagttggtgcctggggaagacagtctgccaaaacagagaaaacacctgaagctgatgatcagctgtttcccaataagaactcaggagttaggtgagccggctcaagcatgtgcattcagaggcaaaatggcagagtttaacctgcgtatgaccttcctctggaaacgcttgactcgtaagggaaaaatgctcaagtgagcatgtgcacaagttcagtaaacacactgcacatgtggcccctcctaagtgcgggtaggctactatgcatgtggacagctcaccccaagggaagaatcaagggaggagaaaagcaaaccctgcaaccttgccaatgtatcaaaccccaagtccagtgctgaatggtgttcttggatctctccaatggtctgcttggccctcttccaagtgtactttgctgcctttcattcctgctttaaaacattttaacaaagtatcactcctgctctaaaacttgccttggcctctccctctgccttaaacctacttctgcccctcggcttaattctttcctccaaggagacaaggatccagtgtgcttcagacccttgtggattcgctgctggtaacatactgagtggtgacctggagacaaggttgagtataataagaaacataccaggcaaagttgaaggcttccaaccagctatagcaatcttggtccagttgctaaaattctgagcctcaatggcccattttgtaaaatgaatttaaaaatggccatccagagaatgccactaataatgttattaatgttgaactagaaagtagaaaagccgccagcaaatgtcatctactcttgttaatgtcatcagtaattacacccctccattgcttttccctctctgttggtggaaggcttctttcacttcctttgctttctatgtatcagtttgtccctctcacacaggtgatgatataaacgttggaggatttttatctttactccacatttgctacccatacttagtttttctaaaactattggcaacaaaatcacctgcaggcttgctttaaatggggatttatgtgcccattccaaaatgactgaatctaaatctctgggtgagacttagaaagattcttgctttcataacaaatcctcaggtgattttttaactgcagtttgaaaatcacagagagagttgtttggaaatgactctttgtctgtgatcacgtatctcttctccactctaaaatagcatttgcaatgtattacctttttaccagcacagagagtcctctgcaggttttataactctcctgaggagtctagctcctggccaaaataatgatgtgaaatttttcaggcctgactataggcaattacaaaggctttacctggcaggcttcactgggaaaagctgccctttacacaccagacttggtgtaagaccaagtccattgcaatctctggagggagttgtagtcaaggactcaggtcctccaggccaaccaaactcttctgcatatctgcgtttctagcccaggcgtctctgtatttcgggccttccataaaggcctttctttttgtcaaaatcttcttacaggaaagatgaaagaaacttgaagaccctttctttgctgtggctcagtactcagcactattccatgactcgctctttcccctctctctcccctctccacataccctctgtaaaacaccaggacagcaggaaacttttgtttgaggctccctaagcaaggaaatgacccacattttggtgtcgatgtacctgacccctaatcatggggaaatggagcaacctgagagtgggagccagaagtcagagcttgctctgatttagttatacgatctcggtcagtgatttaaagcttcactggcactctgattttctgcttgttgtttttaatgtgcaactctgacacctggctactcagctctctctccagctcagctgagctcctcctgcccatgttcccacactgttgcaactcttcccaaatctgtaatttagtattatggagcatctggagggaaacaaaagaaaaaaaaaacattttttcaaaaaattagtcctggaggaacccagctgtcttcattccctccttagtctactctgggctgcaacaggtgtaggaaaatgatgctaccatccagacctttgcagctacaatttgacaaagaccaacctcacgtgacctctcaacattgccagcaatcctgctccttcttccttagccctgctggttcaccctctgctcatcccctgatttacgttttccaccatatctaacttctgagccctctgtttccctgtgggtgcaaggaaattcttctattcagatcgggaaaaagataacagggacgatattacaaaaacttcctcagttccctgtccttcctccttctctcctttgcaataaaatcccccttctcttttcaaagtccaatgtcttgttttttgtttgtttgtttgtttgtttgtttttgagacagagtctcgctttgtcacccaggctggagtgcagtggggggatctcggctcacagcaacctccacctcctgggttcaagcgattctcctgcctcaggcacctgagtagctgggactacaggcgcccaccatcatgctcagctaatttttgtatttttaatggagatggggtttcaccatattggtcaggctggtcttgaactcctgatcttgtgatccgcccacctcggcgttccaaagtgctgggattacaggtgtgagccaccacacctggcccaaagtctaatgtcttttatctgtgctccacccattacttcccacctcctaaagaaccttattacattgatctttctctctctgtgttgacaaccctcttgcactctgctcactgctttacattaatgtttaaacatcctcaaatttcttccaccttataagaaaaataaacaaataaccccacatcttccccttactagttacttctttcaaatatcaggacattctagcccatagatagctctactttcttagtatttagtatttgaaatgtagctgatgcaaatgaggaactgatattttcatattatttaattttgattaatttaaatttaaataaagataagtggctatcagctattgtatcagacaagcagacccagataaacaaacactgagacttacatttcaaagcttatcatgccacataactgacaacgataatgtcccaatataaataaacttaaacattttaagaccttacttgtgatcttatataagaaaattcatgtctacattttataatttctccatttccaacagattaatcttctctttgagtagtaatgactgttccagctaggctattccacagagatgcttaaatgtgtttatttaaataaaattttattgttagatatagtgttatgataaaatgactacatattacaaaatatttccattactgcagaaagttctaatggacattactgtgaacaatgtacttttcttttgtcaacaataatgccacttggacatttttaggatggtgaatttgtgcatgacaaaaaagtcatttttattatatttcaaatgtgtattatatttatggccatattagattttgtatttgtattaacttttagcagtttcaccattgatctaatactggccacaagtgaaacagaaatgttactcttagatacacattaaaataaattgttaaaacttcgtagtaattccagtgaagcattccaacacaatttctaattggaacactttttacctgtttactcacagaatctatagttcctctagaaacgataactgagttctacaaatctgcttttttcaccattactgcattctatacctgttctaaatgttatatctacagtaactttttttatattaagcatatcagtcaagtacttggcaaaggctgggtgcggtgtctcatacctgtaataccagcactttgggaggccaaggtgggcagatcacctgaggtcaggagttcgagaccatcctggccaacatggtgaaaccccatctctactaaaaatacaaaaattagctgggcatggtggtgcacgactgtaatcccagctacttgggaggctgaggcaggagaatcacttgaaccctggaggtggaggttgcagtgagacgtgactgtgccattgtactccagcctgagcaacaagagtaaaactctgtctctaaaacaacaacaacaaaaaatacttggcatatatgaagtacagcaaactatgaaaagtgttatgaaagtaaataaaatttaatttaaattttttcctgaaaatatttttttctctttgtgtagacaacagcaagaatcagcagcttatataatcatccattgcatttcagataacaattattgcctctgtctttatttcaggtcaccacaaataggtagttctgcatctttctaatcaagtgtgcaaggagaaacacagctgaaacttaacaggtaggcgtatattttaaaaacctcttcatgaggcttctgcccattccctaatgctgtttcacacccacaccttaatagagtttctgctcactgttcatattataccaagaaaattagcaagttaatgtagaacactgaaataagtatttactagtcattaaccttctagaatattgaagcatggtagactgtactttacatatgttatcccaatttatcctcaaaatgccatgtaataatttaaaggcaatcattaagggaaacatattgcagttaactgggagctaaaccgcctggattcaaatcctggctcccacaattcttagtcatatccacttggacaaattacctaagttctctgtgcattcctcacctgtaaaatatgaaaaatgatggaatctacctcaaagggtccttataaaaattatgtgagtttatatttgtaaagaatgtagcacaggcctggcacactggctcacgcctgtcatcccaactctttgggaggctgaggcgggcggatcacaggtcaggagttcaagaccaacctggccaacatggcaaaaccccatctctactaaaaacacaaaagttagctgggcatggtggcacgcacctgtggtcccagctactcaggaggctgaggtaggagaccctttgtttgaacctgggaggtggaggttgccgtaagcggagatcatgccactgcactccagcctgggccactgagcaagactctgtctcaagaaaaaaaaaaaaaaaaaaaagaatgtagcacagtgtttcatgactgatgcaatcattctgctgggtgccaagaatgttagctgctgaaggctgactctctccatgagaactggcttcacctgaacaaaatggcatgcccaaggttatgcctccactggccatcaaatgcagccagtgtggtggtgcagaagctcagcccttgcctcaacatgggacatctctgaaggcccatcttggtgccagagctcctcatgcaagcagcacaggcctcttttgcagctacatcaaaagtcaacttctttctttttctgctcctgcttctcctcttcttttataggtagtgcttctgagatccttctcatataaacaccctgaagacaggtatctatttagagtctgtttccttaaatccaagatgctacggtagttttcaggagtgatcttatgacgtatactctataaggttactgtaaagctgagtcacccactgaccacaatgaaatggcaaagaagagcacatcacagacactagatactgagagcctggacatgctatagcagtacagtcattcaattttcaccagtagtgaattagaatagaaccatggtgaaagggaaggcactgatggttcaatcactcaggcaattgagtttcaaggaagtcagtagcagttataaggagcgtggaatctgaatactgccactgggtactactgatgcattgtgaaatacagggaaaggctaagagtgatcaatgacctattttaaacaaggtctgagagtcagaagacctccatggaggcatataaaagattctcattcactgtagccagagggcgagaaaagctgaggagtaagcccaggacataattagaaaggtagagcacttcagaggaggttgaattttcatatcaagcaagtctgctattccaagaacctatctgggaaagactggaagcctgggatttgagaaagggatatttgaattaatgtccttgaacacactggggcctgcacaaatggcccactcctgcctgataaggttctgctgtcctttcttgcttgaagatgatgcagagggctctgcttgtacaataaatatcatccccctaaagacttatcccacctccccttctggccactaggctaataccaagtgccaagatacaacataaactgactaagaaaatgctaggcctgctacgagtaaaaaggaactgtagcccaaaggacttgatagtaccgagccaacattcctgcaggagctgtgagagtttgcatagtattgtatcctgagagagagagatgaagtgtggagggtaaagaagttggataagggacagtatattgacatggtagcacatctttatgatgcaagccttaatatactggtaagcgcacaggaagaagacataaacccactactaggatggcattcttaaaaaattgaaaatatccatggacctggactgcctggtcattccacagaacatcacagtagtccactgaatatataacattgtattaaaaggatatgataagcaagaagcacactgggtcttgttaaacagatagtaatggaataggaatgaaaaaattgccatagcagatggtaaaatagtagatataaaagctcaaagaagtaatcacgttgttgtagacctactacataattgcagaaatctatgtccagggcaggagaagggaggaagttaatgctctgtttactaaaatgataagaattagaacagtgaggggagccccatcatctttgagaagctaataggttgtcttcagtagggaagagttaaatataataggtaatgctacagaagcggacttcttaatagtcatgggcatcataggatcctgaaataaacaagctggtgcaattatcacaatgacagcaagttttgagtggtagccaagtagcataaaccttagggaccctagaggaaaatggaaggacagatattcagagtattgctcaatcaatatgtctaaaataaatcaaggattgatgatcaggaggttgagggcagctgccccaagaagtaatgatgcctttctcaatgtccagatcagagccagtttttcaaacctggaacacagtgatgcacggagagactgggtccacagacgaacacatacacttcaacaaatatttgtggtcctgatttttcccatacttccccaaaagaacctgtggtcatttacttaagtaacaatacactacaaaggaaagaagaatactcagacaattcaaggaaagttgaacataggatttgagttgacaaggacactagccattcattctgaagggtcatcaagcttcctctcagctggaaaacgggcatattagggccgcataactaataaatcctggtccagttctggcttccagtgtggccacaggccaaaccaggggtcatttcttcaacctataaatgtataattttaatgagtatacttggaaatggacagtcccaccatatttttttccttggactatggagtaagggctatcacagtggggaaggccaagttgaagcctctaagtctgccctgcccacttacccatccccagacagatgcacctgcgtgtatgaaatacacacacacacacacggagaatgacagaaattactatcatccttcaggacttaaagaaagaagggcgtagcctatctccaacaaaaataggggtaaggaatgcatatgcaggtcatagctgaccccagcgggagagtcacaatacagaccatctgcatcagagacatctactgacttagaaaaactgctgttggttctgtgtgaagagagaacacctctcttcacacagaaaataatactgtatggtctaaacttagctaggtagtaactataatttcagtgccagatattatgtctttgctagagctaaacagcatgacctcagtgtggccattgatctgacaaattcattcttgttcatctctctcaggacctgtaccagaagcagttctcatttatatggaggagataaaagttcctacttacgtatgctcttatgtaagagccacgttgactctcccattagtatctccctacatagatactaaagggacctggactgcctggtctttctacagaacatcaaaatagtccactgaatgtataacattgtattaaaaggatctgataagaagcacactcgggaccttgttaaacagatatgttccacaggacaggagataaattctactaaaattctggtgacatttgcagggatccagtgatctgttgtataccatgacatctgctctatagaaaaggtcaaattatttcatcttgcatctttcatcattcagaagaaatctcaatagctagaagtcttcgagattttgtaaggaacttttccatattgggaaataatgcctgccccatctatcaagtgacacggaaggcttcaagtgaggattggaaaaggaaaaggctctggagtgggttcaggctgcaatgttaacatccctgccacttgatccataagacccagcagaccttatggcattacaggtatcacaggtggaaaaagaatgcatatgcaggtcatagctgaccccagtgggagagtcacaatacagaccatctgcatcagagaaatctactgacttagaaaaacagctgctggttccatgagaagagagaacacctcactttgcggccagatagcaaacatgtctaaggatctatcagatccaataagtcgtaaggttgttatggtcacatagtagcaatccactgagtctgcaagtggttcatccactatcaagcctgaccagggagaaaatgcacaaataatcttcatgaagaggtggcttagacattccccacaacgtcatttgccactgctacattggtgtctatctttaccttggactaataggataggatcaccttatgaccaggcagataaagtgatggaacagcttttgaaagatgtaactgaagtgccagcttaaaagtaatacaacctgagaagagaacaatacccttccagctgcagtctatatcctgcagcgatgactaatataggatcccatgctccaatacatggaacagattggtctgaggaagaaaggggaaggtcctaggcatggcttctcttaccatcactcccagtgactgcttgagtaatttgtgacactcagccccaccttagactcagagtttagaaagcctgggtaccagaggggaaatagctccatcaggagacagacacagcaagagcccccacatacataaaactttaaaacctataagtaagactatatattggttttattaatattacatatatatgaaagaattatggacacaaaatgacaggctaaaaggaatatgattgagagatacacaaagcctttgctataactgtaatattttaacagtaatttttattccttaaaatgtacttaaagaagacatgtatgtaccccctaaatatgtagatctatgatgcagcaatacgaaattaagaaaaataaagaacatttaataatcttcaaatacaagaacacgtgtcacattttaaatattttgaagtaagtggtgttatctctgttctctgaaagcaatgataccatagacagcggcacggctgagtgcttcagtgggctctggggtggagactgggggagatactcatatagactatgatgtgattgaggccacctggaatttttcagtgtgctgattctatttgtccatttctgcatatctggaatgttttattattaaatacattaacaaacaatccaaggtccagagaagttaagtaagtcacctattatcacccagtcataggaatagctgttcctcaaattcaagcctgaaaatacccaaggcttgcaaccacaggatggattaaaacattgcaagtattttaaataacgtcaacccatatgtggaacaatcatgtcgctttaactgtgatcacaactttattcagtagggatagtgttaccatcctcctcaattaaaaatctaaaaggcccctgattcctctggtcaccttaagataattaaaaaagtcttcttgtcactttagtcattaaaagtaattcatttcagtaattagaatgcctgcaataattagaatgccagtaaaaactctgaacttgatttaatgtcaaagtcttctcccttccttccagctaccatgcaaagttgtgcagagggaagtgatatgtaatgggataggccagttcttgtacagctgtatgcctttgggcttttgatttctgaaatggtaaaagcagatcctttctcttgtaggctcttttgagctctttggagatggaggttcctctttggattcctctcttctgtagttcctttgacccagggggatgacagagacctgctatagcactacggcactatctatccccatcttctttatgctgagctatcctctaaagcaggctttttggataggacccaagaggctttctctcctgcatgttccaggtacagtacatcaaaagactcaagcaactctggctcgagtatatttgagaagaccatatgaatcccaaaagtactcttctggctccaatatcaaagaagttaatctcaccttcttggttccctcgtcatgactgaaaccttggtcctcattcagctgtgtcttcatcagatatggagtgggcaccagtcctcatgtgcaggaaacgtatttcaaagttttgtgactgttccactggaagacctttgcctgtgtttgggcaagaagatagtcccgacccctccatttctagggaacggagcaggggatcatatcactgtaatggttctttccaaataaactctctgggccaatccattcaactacattctatgactccatgttatagcctttatctgactgatgattaccaaagtagggaaacagctttatcggaccatgttctttctaaatctacgtatgggacagggagctggcaaattctattctttctcagtgaagagatatgaaaaggccaggctcttcttttttcgttggtgtctaattaatctaacagagactgttaagaatacagaaaaaaatggccaggtgctgtggctcatgcctgtcattccagcactttgggaggccgaggcaggctgatcacttgaagtcagcagttcaagaccagcctggccaacatggtgaaataccgtctctactaaaaatacaaaaattagccgagtgtggtggcaggcacctgtaatcccagatactcaggaggctgaggcaggacaatcccttgaaccagggaggcagaggttgcagtgaggtgagatggcaccactgcacttcagcctgggtgacagagcgaaacgccgtctcaaaaataaataaataaataaataaataaataaataaataaataaataaaagaatgcagaaaaaacaggttataaagtttctgtaacactggaaccaaatattgcccttctcaattctggaatatttccaagagggaatatcactagagttgtttaaccctacagaagcacaatggaaaataaaataattaaaatatttcaaaaagtgatgtttgctttaaaaaatgatctatactaagaactaccctgatttctttaaagcttatcaacttattttaaaaataaacacagcacatgcatatggttgaaacctaaactattgagactggaaaaaattaagttttgtccctgtcccagtcccttttcaagaagctaaattctataaagaatttttgatatttctattaaaatgcatatatctagtatgcataaataatatatataacactcatttattttcacaattatggttgtactagatgcacccttttttgtagtgttttattcacttaataatatattttggatatcttccatcaccagtacaggtaaatcctcattgcatctgatagcttcattctaggcacagaaagcattttatttaaccaattttatattggtaattacttaggtcatttccattctttcactgttattgagttgaaaaagcattcttgtatatatatcttggaaggctggaaagaatactcatgggggaaacttctagcttagtcgctgggcctatgacgacatgcaggttaacttttgactactagaaagtccactgctttccaagtggttgcaccagttacatacccacagtgctagttgagaagctttacccaaattctcaaaaacaagaaagttattaaatttcttaatttgggcccctctgcagaagaaaaataacatatttaattttccttctctatttctgttgcctatgtgaatttgtttattgtacaatgaaaatccatctcctttgcatctttttcaaatagttgttagccttaaaaaaatagtctatgaatgccttctataaactgctgaaattagcttgtcttgtccaccatatgggttacaattttgtctcagtatattgtaattttaaggatgttttatatgcaaaagctttttaaagtttttatgtaattaaatttatcaacccttagcaaaaactattattttaagctgaaatctgaggagttagaataaaatcatttataatcatttttctcctttgtctttactttttacatttgcttatgtttgataacactttgtaaattttaaacttttatttgcttaagtggcagtgcctattttaactgagaaagtagtttagttttccaagaaatactaatattaactgtgtataatagaaatctttacatatataatctcatataatcctcttcataacatgtagtatcatttttatcccttttagcagatggagaaattgaagttcagagacatgaagccattgtcacagatctcatactgaacacataggtctaactgacatcaatgcccatcaatttttcctgtgccaagatgcctctctgcttaactcaggtttgtttgcatataaaatataatggcacagctttgagttttgttttgtatatttaccagccaccatttttttttaccagaaaatattgtagggtaaagatgtcctactctataaacactatactctatacacattaagaaatgggaaatgagaaaataaagtgcttgaaccctaagaccaaatgtattaattccaattcctaaaacacatgcctgaataattcaaaatgattttgcaaaatagatattatcatattactgtatggaagaaataagtaaccaataaaaagggggttacttttgtagactcatggtttgagaagctgtcatttattttggtcattgttttagatatattattcactgtctcttcattattcttttcaatgtaaattatatagggtaaaaaaggctgccatttattctactccctactgttcagagaatgggaaagtggagcccaaaatgttctcatatattttcacaagcatctgttagttactctgtggagccatctactttttcctaatatgtcacaaataatagttgaaactgtgggtcaatgattttggccaaacttgttatcccaactcctagagtgaaggaagtatatgtccttggggaatagagtatcctcagtgatgtaagtttaaactttcagtttatgaaggtcaattgtgcaatgagagaactgtctttcttcaaagataaatgtaacttatctatgtgtcctatttttgttgtgagcagaataccaacttgcagttgaccataatcatgccccttctagattaaaatgtggtcatctcagttcttgtcattccctacctctaaagtgatctaaatttttaggaacttctctatgccttggcagcaatgaaggtgtttctgtcccatgtcacctcatctattcttagtggccacaagcctagagcagctgagctcaccaaggatactgcttctgcctgattgtggccattgtcattcactgacatctgctatagttggatgacaggatgtgtcagtgtgaggatgtgtgctgtgatccccatggcctcctgttacaaggaccatgtactcagcatctttttcactaggaccacagacctttgcgtatctgttgggctcacacagcatttctgcagggcctgagtaacacttggctatgcttgttaccacacagtccttaaggaaactttgtgagtcagccccctctgtctaaagacttaacctcactgctaacctaccatcaggcatcatcatgattacagggcttgccacagagccttttgctttggagctcacaaaattactgtgggttccattacctttttatggtttccactaataaaggtctgggacagtggtgacaggagggtgcttgccaaaaagatgctactcaagaaaccaacatttaaaatctcatcatgtccctccatgtcgcctcttcttcccataaccctgctgaatttatgtctcttagagcagaaagaacttccctgagaaccctgcagtcttccctattttgtcatttatagtctaaacttaaggctcttattcccccaggctttagttctctatctttaaagagatttcaaagactcttttctcttacgctgtcatcataagctttcaatgacttattttggaatataaagaaaagacttcacttcttttttccatatgtccacattcctcccaaagacataattacagaaatttctctgatgacaatgagagatatggagaaaggccctgggtcagggaattagagaggtgggtggtcttagggatgatggaatgacagttcagtatctcaaactgttttacctttacactagtaaaaagtgaaaggcagtagtgaagttacagcaaatcatcaggagggaaagggggcttaatctgaagaggaattaaacacatcctcttttctttccttataacaatggttgtcttgtgatggataacctccaggttaccacatggaaacttaacatgtcatggtacagctgattattccctctttctggaaacactcccttcatttagctcctgggacaccacaccctcattctcctaatacctctctgctgctgcttctcaggcttctttgctccttcatcctttaaacttaagatatcctcagctccatccgtgcaacctttctctttggtatcaaccaaagtgatctcatgtagactttaaataatattaacatgctactcactatcaattgtgaatttctaattttggggatttggggatatgcttattctctgtgtgtacagatgcacaaatatcttagacatcttaaacttaaaatgtccaaaacaacctcaccttcccctaaatgaattcccaaaactgtctccccatctcagtaatggcaactctattcttcctattattatactttagaccatttttttctcacatgccaaatccaatccagtagtaaattctgtcagttctaccctcaaaatttcttcagaatttgatcaattgttactaccttcaccaataccatttttgtcccagcgactattattccatctaaattccatctaagttcctaaattccatctcaccttgtcttccctccagcctattttgtatatgatttccaggaaaagcctcttaatgcataagaagaaaattttactttgtcttcaaaaccatctgcctgttttcttcaagaaaaaaaggataaagtccttacaaagatcaaattaggttcatatacccaagtttctggttaccttctcaactcatttctaaacatttttctattcattaattaacctccagacacactggactccttgctgctccttgaatattctactgacccaaggcttttgtactcactgttccacagccttgagcaatcttcttgtgggttaactagaaaacagagcccaccagaatattttacaaccaaatatttcttggttgttgctatttcaagaaagcaagagtatgggaaaaagagaattaggtcaaggaaggatgaaatacaaatacaatgtgatgtgtgactgaactggtgacagatttgctgaaaaatgcagctgactgctcttctgtgcaatatgtcttagaagaggtcatatggatacattgcattttaaggcagtctgtcagaggaaagacggaaaagaatttagttgatagctcctttatgtctctcattattgaaatttcaacccatagaaatgcaacgcccttacatttcctaagttcattcattccactgaacagaaaatcatggctaaacaatttgggtcaatacctgcattgaatcttgtattgccacccatgatacacatacattctcttacattttattctaagattccctgaattcttctacctaaagaggaaatacaagtcaataaaaatgaggcaactacaattcctgggacaacagctactcctggggccacaattaatctttgtctacctcctccaacttcttattccaaattcccctgattttcatccagaaatgtgtgtatggtctaatttgcatgcctgacaagttttcaaaaaatctgcagggtcataactcttatggaaaatgaatgcctcaaaagataccttgaaaaatcccttgaggtttgaacatattcctgcatgccccattgtgtaacagaaatactagctcctagaggtatgtttgctgcaagctaattaatcttaggatccaatgcctttaacttacaagggcctcctctaaagccctctacttaatttcttattagtaatttttattttctttttatgaagagtctcttccctcattttgtaggcttcaggctcaataaaatctggctatgtcagggtcaattactcaaagtacagtaattccctttttacctgttaatccactggtttaagacatctaaatgcatagtagcagctgctttcaggttagtgtaatacatattatatctcctgatagatgtgttaccccaaaagaaatgacttctaacctgacaaagcttaaagttgcagaatcatcaaccgtaagttcatgactggccactaggaatgatgtgaaaggaaccaatcctacttccaggctttggttcttggattgatgtatggcagttcttaagacacagcaccatagatggctaattgggttaatgaagatattaaaccctgaaggatacactattaaacctaatgtagcaccataggtgagcttttaacagtctggttctattctactaggtgagctgcctctgggttatatggtacaaaatagaagactgtgaatacttttaaaaaaatattattacatctcccatgccattacactggtcatgtgtctgaactaatattgaatggaatgccaggtcaggagaaaagtcctctgtatatcctcagataatgctgcatgcagaatcattatgacccagacacagccatgaagggcaatggtggtgttcaatgattctctctaacaaagatgaaaacctcatatctgttttgtataaaaatgtggttgataccattgtcaaccaaaataaaaaaaggaggttaaaattaatataagtagaatttatttgaaccaaatatgaggactatagtgctgaacacatagattcaaattgctctaaatatatgctctattagcagcagttacaagtgggtttttaaagaataaaagagaggaggctgtttctaaattatttactatgaattactattaaaataatagaagatattgattggctatacattgttgtttgtaacacaaattctgggaacatgaacataatggatgaggcagctaatcagaaaactatagggaagaaaaagaacaaaatgtctttatgcaattgccccaggcatgagcaggtattggaggcatgactgaatgctcaagtctctctaggcctgatacattttgcatacttcacacagtacagactgctctgagctatttttctttccccactaggcaatctttctcgagggttatcagatgctttacgcagaaaactatggcagagtaaatttggggaagtgcataaacatgtcttgtctcctcacttctttcaggtcttgaaactaccttcataacttgaatgaaaagtcacaaggttagaattgtggtaggggcctgagtgctgctaagatgtaggcatagtttaaagataaacaatcattgttcccctcgcttgccttttttttttttttgagacggagtctcactctgtcacccaggctggagtgcagtggcgtgatctcagttcactgcaagctccgcctcccgggttcatgccgttttcctgcctcagcctcctgagtagctgggactacaggcgccgccaccatgcccggctaattttttgtatttttagtagagacggggtttcaccgtggtcttgatcttgtgacctcatgatctgcccgcctcagcctcccaaagtgctgggattacaggtgtgagccaccgtgcccagccgcttatgtttttaaaattgcttactgctcaggagtcacataaccagtgatcacaagacctgtaactctataaattattcctatagataacatcactactgagaaatctaagactcatctttgacatatttttcaaactttgcattctactgaaccagctgatgccacttggattagtgacccataccaggaaattgaatcaactggttctgtgacctccatccaggaactgactcaatgcaaaaaaaaaaaaatttcaacacccctgtgattttatccctcacccaacaaataaacagtacccactccctagcctcctgctgaccaagccatcattaaaaaccctaacctgcaaaacttgggggaggcagctttgagacatatctcccatctccttgccaagctgccctttattattaaaactctttctctgctgcaacaactgctgtctccctgtattggcttttcttgtgcagcaggcaagaagaaccgggtggggctgtaagagtgtcttctcaaatatgaatgctactaagccttcacttacccctttatgtaaagtaacaccatctctgtgacatttcttcatatccaacttattcttcattagttttctttgaaacacacatcatctaacacgacatatttacatactcattttatttatttatttgtttttttggctttttttttttgagacagggtctccctcagtcacccatgctgagtgcaatggcatgatcacagcttgctgcagcctcaagctctctgggctcaggtggtcctcccacctcagcctctcaagtagctgggactataggctcatgccactacacccagctaatttttctaatttttttgtagatacaaggttttgccacattgtgcaggctggactcaaactcctgggctcaagaaatccatcacccttggcctcccaaagtattgggattaaagttacgaaccactgtacccagcctacatactcattttaaatgccatattaccactctaaaatgtaagcttcatgaagtcatgtatttgttgttaactcagtacctgaaacaaggtacatatttggttgtcaatatacatttcaaaaaatatataaatacatgcatttgaggagtagactttagagtcattgaggtcttcataaataataatgtatcattcagaaatggcagagctgattaggaaggcactgttgggaacacaggtgatcatcagaaggatttgcaacagagaagaaggcctgaaacacaggcactccctgttcttcagtcatagtcagtggattagatttgggaagtaggttaaaggattgaaatttccttttaagtgaaaatttaaatgaaaataaaaatgttaaaaatgtgtaatctcagccgggcacagtggctcatgcttgtaatcctagcactttgggaggctgaggtgggtggattgtctgagctcaggagttcgagacccgcctgggcaacactgaaaccccatctctactaaaatacagaaaattagctgggcgtgggggcgtgtgcctgcagtcccagctactcgggaggctgaggcaggagaattgcttgaatccaggaggcagaggttgaagtgagtggagatcacgccaccgcactccagcctgggcgacagagcaagactctgtcaaaaaaaaaattataatctcaacctaatttttggagaagagatatgtagaattacttttaaagagatttattgattcctgaaccagcaagatttaatcatacaacattaacattttaaggaacaaatatttcaatcaaaagaaaaggtaagtttagttagccaaagaaatgatatatagatttgagaattacagtgtgataacttgtcagtgcttatataaacattatccatgggatgaggtttgctgattcaacaacagaaaaaccttagtaccagtgacatctgtaaaatgttaatactgacaggaatggacatttccgcctatcttagcccaatacattaaatattcaaatcacgtaactgttataaatccatgtcactcatgcagttttttttttagtaaaataaagcttctttcatggcttccttttataaagataagatgcaaggggtctttttggaacatttatgcataataatattgatttattttcatttgaaagagttttttctttttcaaaaaaaaagactcaatatgaatgctacccaaattctataaagtaagaaatgttttaattttaaaacagtaggaaggacataaacacagaataactcatctaaatttagtacacttagctttatgaaaattcactatataattgcactcatttttccctattttggaacagacgcatacatttattttcaaaaattggcacctgatacctgccattgtttaagaacaaggttgaatgacactcctgtataatctcacagggtcgcgactcatagcactcctcgcactgtattataatgacctgttcacctgtgtactggatttgcattaatttagaatcatagtcagaggacattgtgtttttatttttgtaaatgataaaatctcatgttgacctttaacagggtgagttgtcagagaaaacttcttctaaatgattttggtaggaacatttttattcttagggatgtaagatgattccaaatggcatgatttcagaaaatgtgggcatatgacctttgatctttaaagtgaccatttctgagctgctcattactcatcatcccatgcctactaaccccaccactatttaaatgtgtgtttgcctttaggctactagaacagtgctactggccttttctcaagctcccaagacagaatatctacttgtttcacaggcacatgccatcaaatgcctcaaaaacccttttggatttgtgcaggagtgaggcacaggttgctgccactagtggaagtctgtcaccgattccattgtctattctggatacgtcatttctaatccctccaactccctcattccatcatcagcaacccagcctcatttcctgaatgagttattccatgtgattagaagtcttgatagttctcctcagtagaaaaatgaagataataattccttggactcacatttgagtttcattatgctcgtaatggtgggaaggttgcagtagaaaaggatttgagaaaacaattctcataatttcattttttttctgagtgtcctacaggagtgaaagaaagccagaaattattctttgattaaatcacttttctatatttgtctatctcccaattataccacaagctctttggtccacggacattttgccctttaccagtttttaaaggcctacttagaaattggaacatagaaaatgctcaaaaaaatcacatgaacccaggaggcagaggttgcagtgagccgagatcaccccactgcactccagcctgggcgacagagcgagactttatctcaaaaaaaaaaaaaaaaaaaaagaaagaaaagaaaaaagaaaagaaaatgctcaaaaaatatttgctcaatgaatgaatgaactcgtgaaacagtgttagctttaaagtcagtgccacttaatatcagcagagtatacggatttcctatggaaatttctggatagactgtacgtaccaagtcccctcagcatttacattcatcaatgtaaattttaaagtagtaagaaatttgtgtacagatgtctttgacaaaacggttcatttgaatccattcctgaagcacaggttaatgcttaaatactgccaaattaactttctaaaacatgaattattaagggacagattacatccattgccatcttttcaggtgccatgtgctttttcttttgagaattatataactgctgtttaatatgccttatacattttttttttctgtcagttaggcttctgagtctattctatgagcatttgcataatgttgcacttgtgagcgacgtggttagtttagttaaagcaggctagctatacatccaacattcaaggtcccctttcaatggtgtggatttttcactaagcaatggttatcccgtcaaatctatgcttcctagcttgggctaccattagatcttggccatgtatttgactgcatatttgaccaaggttcaataagtagagtggttgtaaaagtgatgatcaccactcccaggcctggccacaaaactccaatgcaaatctcttttctgatccctttccagctaggtagagtgagtatagcccccaataccatttggaagagagagagaacctctgtcactctagaacatggacaactgcatagtggaaggccacccactgacctgctcagccaccatctcacagagtaaggaagacaatcctccaggcataacacatattcccagagtattttttgcatcattagcatatacttgaagggttaaatcagttcactatggtagacagctccagattcctgatgtacctcatggggaggagatcatctttattagaaatcaacaattaggtctagagtggaaaaacatcaaatcttactctaatcaaaatcaacaattaggtccagagtggaaaaaaatcaaatctcaatcacaccttacttttggtggctgtttagtgaaccaccaaacaaggcttgtctcaaaaatttgtagagaaaaaacaaacaattaaaaaaaaaaaaaactttagtatttgctgaataatcctaaaactagcaatggttatatgatactgtattgacaatagctttaaatgatcaaaaatggtttcagaagcagatgtctcactataaaaatggagcacaaagtgaatgagcaaaactgatgctgtgctaccaatgaacccaggaagaacggtggtcctgagaacagtgtcctccaggtgccctcggcagagcagctttcaacgaactgcgctctggtgttttactaccatcagaagtgaaggatcattatgtgagctgtgctgtgaaatctgaaaataccactccagggggtgttttttggaagtgagttcatgccacatcacagcatatactttaaaaggacccttgcggaaaattcttttcaggtataaaaatcagaaatagttgtacttttcctgaaaaactggcttgcctttcttctatggacattaagtattgtgtaactgatcttgtttgcttcctcccttgtaagaaagcttagagtcaatttacccgttcatctctagcaggcatagctgccccgcatgttgcatttttgtggggaaaagctcactaaggctttatcttatttttatggcaaaaccatatgttaatatttcttatttccccatttccttttttaattttccatgccatggtatcctagctctttatagtctctcaaaacacagtccaatttaaacatatgaatgtatcttctcatagagactcagaattcataagctatttacattaattaaatattccagataaatacagcaaattgacaatatagttattttagcattatattgcaccaggaaatatacaaatgataaaataaataaattcaaacttcataagaatcttgacatcttctgttagtgcaaaataaaaaataaaatgctagctaccagcatttcattcataaatctcatctattcattaggcaatttctttcttcaattgttttgtctaaacaagttaactgagctcagaaaaccaaataagttaagattcaattgaggtatatgtcttaagcatcaaataccatataaaacaaagcaagcttaggataagcaatccaagagccagaggcaagttcctaagatgaatttctccctaagccagagagaaataagaggatttttcttttaagcaccaggaaggggcagtggggagacctgcaagacaagtttacacatccccaaaggtttataggcttcagtcataatcatgcaatgcataggcagtaatataagcccagtttacactatttctaagcccttaatgcttttatgcactgtaaaaaacactggagaaagaacatactaaaaacatgagaagttgaaaatatttgctcaattgtgtaactgttgaattgcacatattgattgtaacagtgtttattttgaatgcatttttctactgagaatagaaaagtatggggtaataaatacttatataaatatttccttctatagagtaccacagaggaaagggtaagtaggcacagctttctatgatgtaattttccttgtgatctctactttgcttcttactattgctctgagggctttttcactaggtgcatatcaattccatttccccttggtttagctaaggaagatttaaaattctccaaatgattcttactattaaattgaaggaacgtaatacaaagtaaaataaagtataaatacaaaaaaccttcaaaagcccaggaacataactgatagcagaggaatccatttcttttcacttcaagataaaatttaaacaaaaaacaaaaatagatctggcaagtaaaaatttacaagtttcttctccttaaaatcccccaaaggttttcacttattacagtaaaactcctttttaagtgtttcataaactgtctccagcacacctctcttgccttccccaaatgttctgttcttgttcgttattttgccttgtcagctgttccttctctgagcagaaatccctacaacttctcccaccagaaaaatgtcaagtccagagcaaatggcccttcatcagagatgacgttccacaataaaggtaactgcttttttatatcaccactttgggaatataatatccatatttatttacctcctcattatagtggtttttttcagtagttgttctaagactgccctacggaacattgagctcattgggccagatatggattttttgtattctcaggaattaagaaactagctgatccatagtagcatgcaatcatctacttaattaataaaattggcatttagaatacttagtctttgaatcctaatacagctttttaatcttacaaatatttttctactacttacgtttgtactagtgagttcgtcatattacaacgggaactttgaatacttctatccctcaaacactatacataggttctaagaaagcagaatatttagtcatttgttttacactcaggagaaataattttctcagtggcatagtcaatttgagtaaataatcatgttgaagattgttctgcccagaatcaggaatttattaaagtctactcaggaaaaattgcagtcgcaatatgtattgagttagttttattagcaaagcaaatattaagttatctgatcttgtaatgtaacttaaaatttcaaagcccattgtaatcacatgtatagctctgaggtattgagaatttagctgtaaatcagaaaaatagacaaaagcagtacctaccaagacttatactttatacttatctggattttatctccaaagtggtatcatgattttggtttgttgaaagttcttttggatttatctgtcacgtaggactgaagagcatagtgaaattaattaataaagtcctactgttgaattctgattttgttatgagctaaatggtcttgggtgttataattaaaatctctgaaccttagtttgatcacatataaaactggtatcataattcttgcttttaagcatgttgaaggttaaatgagatcatttgtatacaaatgtatataaagttttaatatacataagaatgaatttatcttttctacctaaaagcattttattagtgcaattctagcttcagggcaagatctgagcatgaagatctgtatgtgagtgagggatgtttcattttcacttagcggaagaacacactaagggtagcttaaacaattaggtttatatttttcatggtctagagcaagaaataaggtgtagtctatttttggcagatgcaaatctaggcatcagtcttgtggaaagcagtggtaccagctgcatctgtctttacaagaaaataagacttccacttatgtccaatcggctggaacaggggcacacagttaaccccagttgcaaaataattcaggaaactggacatctcatcttctattatttgaagtgggatatagcaagggagaagggtattagaaatagcctttcagtatttctctcacttttccactgtgatattaaaatgttaataaaatgctagccgtagagacaactaaatgccataatatgatcaatttgctttcaattcaaagcaaacattaactctcagttaagtttaaactgtaggcaggaagcagaaaatacacttgatttcacttctcttagctccttattaaataaaaatatacaaaatgtactttgttttttcccttcactgtttgtgttgtgcatttgaaacatggtcaggcccatttgtttctagttgaatttactttccccttaattgtttattacctttccccataattgcttattaaattcattttgtgtgtatgtgaaatattaatatgatccccaaatgcggaatgttaaaaatggtatactcaaagaagtgtcctgctgacagcctttcctctgttctaatcttcttatcttctctatccgtttcccacctactttctctaaataagtaatctcattagtttctgatttgtgcttgtatgtgttttgtacaaacgagcaaagacatatgctttccgtttgggtttgtttgtttcccattttctatctgacttttggtcttgtcctcaactcaacattatttatttggaccattagctcttaatctgtgatgtgttgcaaatattgtctcccatatgtcccaatatcatctcttgttaacaatctcctgaacttacttaaagcttttcttttcctatgcaacttttatctttttaaaatatgtagtcgattttctatcagacttttaaaattacatttggatttcaagtcatcgctagaaaacttttatttacacagaggcgggaggactacctgaggtcaggagttagagaccagcctggctaacacagtgaaaccccgtttctactacaaatacaaaaaattagccgggcgtggtggcatgtgcctgcaatcccagctactcaggaggctgaggcagaagaatcgcttaaacctgggtggcggaggttgcagtgagccaagattgcaccattgcactccagcttgggcaacaagagtgaaactccatctcaaaacaaacaaacaaacaaacaaacaaacaaaaaaatgaaatgcatactagttttctgctaatacttgaattatttaatttttacatttaaatccattattttgaaaccacttatattttaaatcaaaaatcaagtgtcagaaatttgagatgtatgtaaaatacatcttttatactaattcttttttttagtgtttctaattcttttatttagtgttccatttattaatacacatttaagaaagatttgtggagagtcacagatacaaatatatgttctaatagtgccacttcaatccaatttgtaataggataaatatagaaatataaaatataccagagctattagtttttatcttttcatacatgtaaaaatttcacctaaaaagaatcgagaaaaagaaaactcaataaaatgatattattttaaaacattttccagtttatcatcttttaatgcatgtgacaaatttttgtactattatttaaacttgtcttaaggtattttaaaataatagcatacaagttaacagatactactgcagaaatgaggctacagttcctcctttgatttcttagtaccaatttcataagataaatatatacttcaataatctttaaaagataatcattgaatatagtatatcatgctatttcaaagtaatttaggttaggtgcttttaaacttgaaattacttatattttaaaatattcagcgatatttgagaaatgcacagtaacatcatattgaatggggaaaagttgaaaccattctccctaagaactggaataagacaaggatgcccactttcatcacttctattcaacatagcactggaagtcctagccagagcaattaggtaagataaagaaataaaaggcatccaaattggaaaagaggaagtcaaactatccctgtttgcagatgatatggtcttatgcatagaaaatgctaaagactcctccaaaagactcagatttaatcaataaattcagtaaagtctcaagttacaaaatcaatatacacaaatcaagaactcaatcccatttaaaatgctaagaaaaaaaataactaggaaaatacttaacacggaggtgaaagatctgtacaaggagaactacaaaatacccattaaaaaatcatagatgacacaaatggaaatatatcccatgcttatggattggaagaatcaatattgtgaaaatgaccacagtgaccaatctatagactcaatgcaattcctgtcaaaataccaacatcactcttcacaaaattagataatcctagtatttatatggaaccaaaaaagagcccaaatagccaaatcaacaagaacaaatcttgaggcatcacattacccaacttcagattatactgtaagcctgtggtaaccaaaacaggctgatgtaggtataaaagtagacacacagacttacggaacaaaatagagaatctagaaataaagccaaatacccataaccagctaatctttcacaaagcagacaaaaacaaaaacatatactgaggaaagaacaactctgttgaataagtgatgctgggaaaattggatagccatatgtagaagaatgaaactggacccctatctctcaccacatacaaaagttaactcaagatggattaaagacctaaatctaagatcagataccatgaaaatttttgaagaaaacctaggaaaaactcttctggacattgtcctaggcaaagaatttatgactaagaccttaaaagcaaatgcaacaaaacacaaataaataaatgagactaaattaaactaaaaatattctgcacagcaaaagaaataattaacagagtaaacaggtaacctatagaatgggagaaaatatttgcacgctagacatttgacaaaggactaatatccagaatctacaaggaactcaaacaaatcagcaagaaaaaaaaataatcccactaaaaattgggcaaacaacaagaacatacatttctcaaaggaagagatacaaatggccaaaaaaagtttaaaaaatgttcaacatcactaataatcaggaaaatgcaaattaaaaccacaatgagaaaccaccttactccagccagaattggcattattaaaaagtcaaaaaacaatagatatttgtgtagatatggtgaaaacagaacatgtgtacactgctggtgggaatgtaagttagtaaaatctctatggaatacagtagagagatttatcaaagaactaaaagtagatccaccattcaaaccagcaatcccactactggaattatgcagtaagaacacaaaggtacataagttattatataaaaaagacacctacacttgtacgttcataacagcacaagtcacaactgaaaagacatggaatcagtctaagtgtccatgaaccaatgagtggataaacaaaatgttgtatctatatatttatatactgtggaatactactcagccatgaaaaaaataaagtagtcttttgcagagacttggaactggagggcattatcctaagtgaagtaactcaaaaatggaaaaccaaatatctcatgttcttaccaataagtagaagttaagctacaagtactcaaaggcatgcatagtgatatagtggacactggaaactcagaagaaaggaaaaggcagggtgggaagaaggatgaaaagtaactattggctacaatatacactatttgggtgataggtgcactaaaagcccagacagacttcactactacacaattcatccctgtaatcaaaaactgtttgtacctcttaaactactgaaatttttaaaaaataaataaaagaaataaagtacccaatgaaagattcataatacatgaatatctctaaatgatatgcattaaataaaagcaaaggcgcaatattatcttgttttcattggacactactagaaaaaaactgaaaataataataattacacaaatgctaatgtagacttcattttatccacatggacttaaccccaaaatcatataattctgtagaaatgcagagtttacattagtgatgatgaagggcgatgtcatagaaagacttttaaggctgggcatggtggctcacgcctgtaatcccagcacttggggaggcctaggtgggtggatcatacagtcaggagttcaagaccagcctggccaagatggtaaaaccctgtgtctcctaaaaatacaaaaattagccagtgtagtgatgtgcacctgtaattccagctatttgggaggctgaggcagaggaatcaattgaacccaggagacggaggttgcagtgagccaagatagcgccattgctttccagcctgggcgacagagcaagactccatctaaaaaaaaaaaaaaaaaaaaaagaaaaatctttcaaatgtgatccttgtgttcagggcttgggaaaggggttataaaaattattaaaaaattacatcaaactgaaaatcattttagataatgactactcttttttcagaagaaataatgaaatgaactaaaaactctagatttttgttcatctaaatcatgtttctgcccatatactatttattccactactttccaaatagccatatctcaatttaaggggtataattcatatcttaaaaaatgaaaatgccttcagagaaagtatttcataaattgtatacagaaattagtaagaaaatgtttgtacagcattttgtgctttaacagatatgaaatatttgaatattgtctctacacgatttctcttttcagtgcagtccaaaacatcacttttaaggtaagccatgatgcataattttgctgctggcaaaatagcaaaggttatattgcactttttacattttatgttggtagattccccaagccagttcacctatgctgaagtttaataaaataaatgctcagattgtctaccactgtaagatgcaatcatgatggcttgagataaattttagtctgggattaaaatcttttatttattctcaattaccccaataactgtgggggaagaaactaaaatataaagttatgtataataatttgaccatcttagcagagtcaactctggaatcaatgagcagtgccactgatattgcttgttgtgaaaaaaccatatgcagtctcatatgtacttggaaaaaaatctggtaccagtgacattaccattgatggtcttacttttccatgcagatgcttggaaattttaagtattccaaaagcattccatagtcccacctggcccaatatgtaaattattgacttagtaaaactttttacatgagagaagtttgtgtgctcataaagtatatattcatcgcaggtagtttaagggacatatcaactataagataaacatttttaactgtatatttatgttatcaaaatgagtctattgttctaattacctaaccagttgtttgctcccccttttaattataattttgacatttgacattattagctacttttttctttttattttttttttactttcaatattggctaatttttgttttcctgatatgtttccaccagcatagtgttttgtccagaatgactgaattttcaccaagaaacctgataaatatcttgatccacaacttcctaaatatctaataaattgagtttgcactgaaattttgatataaaagttactccttccttaccctaaagcattgtttaatcatataacaagagaaacaatcaagatgagaaatgattctttttttaaaaaattcagtagttttgtattgagatattctatttacatgtttgttcattccttctgtaaatatttattgagtgcctattatatgccaaacactggactaggtattggggatatgatatgaattaagagcaaatgtccctgtaagatgctgaagttaccatctgattaaaaacaatatgaagatgacgcaaatataattgtgttgtttttttgcattgttgaaatttgccgtttgatactggaatacattcttcaacaaatgtggttatacatcattttaatgagcacttcttgcttttttttttttttgctaattacttattacttgctgtttattttatacttattttaaactatggaaatgatgttagataaaaagcaagtttgggtgattttcttatttcagttcagaatgggttataaagtgcagagacacttgcaacatcaacaacacatttggcccaggaactgctaatgaatctacagtgcagtgtcgcttcaagaagttttgcaaagaaggtgagagccttgaagatgaggagcgtagtggccagtcatcagaagttgacaatgaccaattaagagcaatcatcgaaactgatcctcttacaactacagaagaagttgctgaagaaatcaatgttgaccattctatggtcatttggcatctgaagcaaattggaaaggtgaaaaaacttgataagtggcttcctcatgagctgagcaaaaaaaaaaaaaattgtcgttttgaagtgtcatcttctcttattctacatgacaataattaaaccatttattgatcagactgtgatgtgcaatgaaaagtggattttataagacaaccggtgaggaccagctcagtggttggactgagaaaaaactccaaagcacttcccaaagccaaaactggcaacaaaaaaaatgtcttggtcactgtttggtggcctgctgccggtctgatccaccacagctttctgaatcctggcaacgccattatgtctgagaagtatgctcagcaaatcaaagagatgcaccaaaaactgaaacacctgcagccagcactggtaaacagaaaagggcccaattcttctccacaacaacgcccaaccacacgccgtacagccaatggtccaaaggttgaagaaattgggctacaaagttttgcctcatctgccatattcacctgacctctcgcaaacagactaacactttttcaagcatctcaacaactttttgcagggaaaacacttccaaaaccagcagaatgctgaaaatgctttccatgagttcgtcaaatcccaaagcatggatttttatgcgacaggaataaacaacttatttctcattggcaaaaatgttttgattgtagtggctcctattttgattaataaagatgtgtttgagtctagttataatgatttaaaattcatggtccaaaactgttattacttttgcaacaatctaatattaaatcaatgattcttcaaaccaactatacaactatacaattaaaaatgatggatatattcttagaagaaaagtaaattacaacaaaataaagcagtatgatttagatttacagttcagggaaagcttcacatatatgaataatttctattcatgttaactcatgttaatgtttatatatacacatgtgtgtatacataaaactgtgtattgtatatctgtgtgtatgtgtatatattatatatagatatgtatatatgtgtgtatatatatatatatttatataaaatacacacacatacacatagggacattaccataagtaggatttagataagcacagttgaggggaggtggggtgaaataaagatacagaagatgcaaatagtctcagccagaaagaattgacacaatgctagtgtggctgctgaacagagagagagcaagcaggaaggaagatgagggtggagtaaaaaacaagactatgcaaagctttaccagctacatcaaagaatttagattttatcctaatatagtgggaaggttttgaaggatcctaaatagtgacgcaacaggttccttcgggctgcaatgtgtaaaattgttaaggtgggtatgggaggtaattatgtaagtggggaattcaggtagaaggccttcacaatagcatagacaaaactgctgataggttggccaagagagctgcctttttaaacagaaaaagtgaatagatgcaagacattttttagggaggacaggctattgttgtgaattggtgggaagtgaaataattttaggcaagagccactggctggatggatattttatgacacacactggaggtggaaaagatttgcagggacaccatgaggagtttagtgcattcttgtctaatttgagagggatgtgagcatctggtggagatgtcatgggggaaattaaacgtctaagtcttaagtcaaaagagaagcttgagatttacatgtgaatttctctgacatctagttattggaagtcaggtaatagatgatgttacctaaattaagagtattgattgagaaaagaagcctctttataccaaatataaagaaacctaacctatagaataaaggttttcaatgatttctatgtataaactttccctggagtaactgatatcatgtagtcctatttctattcacagagtctgatttagtcattatggaatagaacccagaaatatgcatttaaatatttgttatgcttctgatgcagttgtttcctggttcagcatgagggaaaaaaagggaggctgaaaaaggtattgcatagttatatgtgtaatcccttatattaaaaaaaagaaaactaagaatcaacagaaaaaaagtgacaaaaaaaaaaagagcctggagaagcaagcagggatcaaattctgctggatcttgtcggctacaataagaatttgggactttttctttacaatcataggaaggcataaaaggctttaggcataattgatatgactagttatatgttgtagaacaataacaaaaaaactggttgtagagtagagatttgttttcaggaagaagactgaacaagaagggtctggttaatagtagcagttgtagtattaagaaactatggtaattagaaataggatggtgatgatagagataggaagaatatggaattgaagggaatgtagaaaggaaattagtgagtacctggtgatgtatacgatgtggaaggtggtaaaagttagagaaatgtcagggtcagtttagccaaccgtttccagcctgtctgtttatggaagatggagtccatcacagccaatgagaaacactggagtagagcctggctttcgggatgatgggtggaagtgggaggatcctgagtgttgtttctaatgtggtgaacttgaatgagataatacaatgaagatgttaaagaggactcacagggtagagttgtaaatgtattaatgtagagacagtaactgaagtcatgggtgtgtatgtgtgtgtaagatcatctatgtagaagaaatagcatgaaaaaaagagaagatcctattgtgctacagtcaagaacaaaactgcatcactgatgattattgcatatcatattaggcttagtcatgtggaaaattagaaagaattataaagactagccatagaaatgctcattttgaataatgtacatgacagaaatatgaattaatactgagaattttatcagaatcactcaaagccagttatttgtcttcagttgtatgaactgccatgggaaaaggcgcagtgagcaaaactctgtttaaattattatttttttcaatgtctgtctgtctgaggtactgaggtgatacagtatggctctgtgcccacacccaaatctcatcttgaaatgtgtccccacgtattgagggagggtcctggtgggaggttatcagatcataggggcagtttcccctatgctgttctagtgatagtgagtgagttctcatgagatctgatggttttaaagtggcactttccccctcgctctctgtctctcctgccaccttgtgaagaaggtgcctgcttccccttcaccttctgccatgattgtaagtttcctgaggctgccccagacatggggaactgtgagtcaattaaacctcttttgtttataaattacccagtctcaggtagttctttatagcagtgtgaaaatgaactaatacatgtgcattacaaatcatcttgacctcacaagtaactgagaaactttaatatgtatgacatttttattacaatttgttaacttcttaatgatggcatgtatgcaagtgtatgtccccaacttgaatatgaatctatttgtgccaaggatgcgattatttggttctttgaatcttttgaaatacttggcttaattctggtcatgtaattaatatgcattaatggatattttttagataaaaactattagaagtaaatgtaataaatgaaaaatgacatgtatttctcttttggcttaacgatgtaaattcaaagagccaacagccaaattgcctcccgctgctacagaatctgatgtgaagttgaacagtgggaaacttctgaataataaaatggactttaactttaaaaatcagatcttgtcataattatctataccacataagggaaaatacattttattgatgtaattctgcttcatttatattacatttaataaagaataagcatgaataattactaaataattttactctttaagaaaaatggaagagaatttctttacaaaagaatgttaatctttataaaatactctacctattttaggttatgtgttctttatttgggttaaaaacaatactaagataatatgtatatgactaaagacaccaagacaataacaaaggatatgccattttcaaggtcttaggtcctcattctcaattcaatttattatttggagcctatgagaaatagggcaaaatgcacaaatcaggataattttctacctcataggaattctgagaataaaggctatgaatacaggaaaataataataaaaatgaagagaagctgggagggaaaaggaaaggtaaatagaaaaaaggtaagaagtagaaaaaacaagagaaggtattatgttttctagatttagtatcttagtttggtactggatattttcatctgcattatatgaattgcattcatttttagataaaaacacagttttcagggaaataaaaattctaggcagccaacagaattcctcacactttgaagtgactctcaagtaacctgttcaagtccattagaagcttcagaagtccccaggtgttcattattacattaccattcttaccacatctccactttctggagagagaaaatagcttaagcaattgtagagagagttggaataagctaagggattgccctgctgttccagacaactttagactaaactatgtccccagatatctgcttcctatagtgaaactttatggaatagggtgttaagacaatctattgaattaatctttaagggctttgtctcttaaatatcatctttattaaaataatatttaccttcatccttttaaatatacattatctttccatctttctcattgcctgttcaatctgccagtaaattatgcatatattgacatgatattttagatattgtggatacaattatgtctcctgtgcatccaatcctttttgctaagcaatatagaccctaaatcacaagtaacactgaaagtagaatttgtacatcatcatagtttgtagaacatttttataaataatatttcatttaagaaagacattgcagtgactgagactcattactataacattttaacagtataaattagtcattaattacaaaagtaaaatagaactagagcaagataaaattttacttgatacctgagtatttttcttcatttttaaccttcatttctttggatgtcagaaaacatactctaaatttttaggccaagacattgacatcttggaaaattcaagtcttgtgtcctagtcacagcatgatttagcaaatccatctaagggaatgcatcaccatactccaccatttcttcatcccaagaatacacttatgtgcttagagttagctaagttatagagaagattagtcagagttaacctatacatgttagcaagccttggttagtcacccagaataaatccatgatgccggcaagcatctattgagtttatggtatggcttctccacataggcagcctgcaagaacgcagcgtatggttactacagagttatctgatatattttctcttcattcacatgtaagctcatccctgcttatttcccttatctcgcttcatattcccacaaatcactccagaaacatctcacttttctagggttcattcatggctgctggttaatactcccaagaacttctgttgggcacaaggagaatgtatgagccctgggaagccagtggattctttgctatcatctcccatctgattccgccactccaccacctgtacccctcccataaccttctcatctatcacagggacggctgcatctaccagaggtgctggtgctctataaactccagctaaaataggaaattcccagatttttcttcgcttcttcctaattccttaactccactctcccatttcaatgcatgaggttgaaataggcctgttcagaagagtcaagaaaaacagaatatacagaaagttatcgttatgtctgagtcccttaccactgacttgaacatagtaaccaggggagagctaacctctgtgatgaaaaacgggatagaaaaatccagccccacagtttaggcaacatgatccttttaatgtttcctctacattagttttctcctaatccttctatctttcttattgcctgttctatctgtcagtgagagctgtgaagtagtatctggtggctcagactagttgagaatggctaagcacaccagctgctccttaacatccttctaagaaactctaagaaaacattaactttacagcccaatccccctgtcaacaatagccagagatgcagagttgccttgtcacaacctgtctgaccccgtgtgaaaatccatacagtatggaaagagcaatatatgttgtctacatattgacagcaaccacatttacactatctagagacaaaggaatagaataagatttttttagaaggttagtgccagaaaggaaactaaagaatatccatctccacattctctttttaaatattaggaaaagctccagggaggttacatgacataaccaaagacacagactgagttgactgttaagttgagactagtacagtgaagatccttaggattctttaattaacacttttctactgagtcacactattctaaacctaataatgttttcaatgcactatcattaaggaattgctgaacagactgttatcttctgacatcattatcactcttcaagtatggattgaggaaaaaatactaaagaaaatatttgctaattgcatactcatttctaggtgcagggttaggcttggaggtgggatgggtcaggagagcataagaaagcactaaatggcagcttttaccttcatttaggagataagtattaatagtcagagtataaataataattcaaggaagtagagaagacaccctaagtgaatacttagggtgtagttcataccactgaaattcagagagaactgaaatcactacggttgaaattgtcttgaaaaactacatccacaggacaagatctctgcggtctggataagcaatgatagttagataagcatggctttatattaaggactagcacatatacggccattttaattaaacgttctaaaacactgtcgggtggatttgtacatgaatctaaattggtaatgtataagggaaactcttttcatgttatagttcttatccatacaaaaataaatgagaaaaacaagaaaagaatgaaaaggaaattttggaatagataatgtaagaacttgatggaatattgcctcagagaaaaagaggaactttctgcaaaggcattgagaagcttcagagagggtcactgggtattcatatacaaacttcagaaaagatggttacaagcgagcttctttctattccctaagtccatttaagcatcaccaaaggcattttttttatatatactaggagaaagggcattttagtggctttagaaatatgtggacagtaaatcttactcaaagtgactgaagaaattagcccaaagcaaagaaaaaataaaagtcaactgcagtcctggttttaccttttgaaagaaaaaaaaaaaaaaaaaaaaacctacagtctattatctctctctctctcgctctctccttctttccttctcattttccctttcattcctttaggaatattatttaataatgcaaataacatatttagaatatatgtcatcatgctgataaatgacaaaaaagtaaagaaaaaagagagagagtataatatagcagcaataccagagacattagtttcagatacatctgaatgcaaatgttgattcacctactttctagttgcgtgattttaggctagctaattaatctctcagagttttatattacagatattatatttgacatctgtaaaatagaaatcaaaataataaactcatgggaaagtttaaacttcataaggggcttaatgcacctttgagctagtatgataacacaaaaatctaattatatttcttatttcctccactgaaatcaatcaatattttatattttctgtattataagaagggtagatactcatgaaattttgcagtgtagtagatgcaggtgaagctatgtattgtttaacccataggtagcaaaagaggctatttttctcttgttacacaagttaaaacaaattaaataccttaaatgtgcataagttatcttatactcagtaaaatgaatgccttagacccttcattttttatcatgaaaaaaatagaaacatgcaactattctgaaatgtgcacaaaagtacttcaactaaatccaacacatctcagattttagggaaataatgtgaatattttagaaagggaagttcaattttccaaaaaagttttgcccaagatgcttgtaaatttacaaacattatctatgttatttcatataattttattctgagtaaaaataaaaccaagggtaacatttatcaacatcaaaaatcactgactcgtcttgtgaacaatgcacatattggaatggtcagtccccattactatctttcacatgataaacactctatttttcttaacttctagaaactatatatgttttatggaatttcattaccaataaagaatataaagtgcctatatctgtggagctttgcagtaattggtatactttatattcaggactatagtcagaccagaaagagctgggaattaggcagaaagaaaaatctgaaaaagaagccatgcaaatgtttgtttatatccatttactctgtctaagcaaacaaaaactgatgaataaacaaataaatatagtaccatgttcaagttgaactatattttagaggaaacaaagaaagcaacattaaatggcaaacaatgctgctgtatgtttgctattctttaactagattcacatatccataaataagataaatgacattttctgatggaattaaatcatcacacttcttgtttctccttaaacagattcaatcacaaaatttaaaaatcctactaatctaaatcaagtaatactttgctttaagctataagatactatgtatctttttaaagtaccaaaaactgaatctataagttaaactaagcatgagagtaaaaaccaagttaggctaaataaaaccaaacacatcacaaaataatatggttttccaaagtctttatattcttctggtaatgtacagggaagtgctttgtaaaatgtgaaaagtaacataattatatcaaccactacttagtctgtgtcttctttctctttttcataacccttatttttcttctttctctctctcccttttcttactcatttaatgcttattgaatgcccactaaccttcaggcagagcacagaagagaaagctatgcatctcaccttaagagatgtatttggttatcatacacattttctattactgaaggacctctttcagtcagacttgtttccatagacaatttattaggcatacaaggaaatgtaaaatgatcaaaacactattctttaactcaactccatgtatttttgatatgtcaaaataataagatgcaccattaaaggacaaggatttccaaattcagaagacgttgatggtaaactacattatattcttactcatgattcatgtaaatgattcatgaaaatagaagtgtaaatgtgttgttcaaatgactgatattgtaaactgaatcactgcagctcaatgaataatctgtgcagctcattcaataatctatgccttcctcaagaatggaggcatatactcgcagttattatttaggggttaattatcatgtttcctttttacttaaataccttcaaattcacaagaagctggttgatctaagcaggtggccacgggaactccccattttctctctgccctttcagacctcctcctcctattcctcaggtagctactgccatataccagcccttgttccccaggaccagtccagactgggtggcacagaagaggcaggaagaaggagagtaaactgcagagctgctacttttccagtttcccacacctggtctatttttccagacatctcaaaatatccatcccttagattatttttggttactcacctaaaaatcattacctcagcctcaaatttgagcattggccatgaagactctcagtcctgatttcctctgaatatgcttggactttattcgaatcatccctcctcgccttggagcattcatggatgtatttgtcaacacctcgggccatggccctaaaaggtttagaaattatgttgttgttgttgttgctgttgttatagttgtttttctttaaataaatatttttttcagttaaatattgcttatttaaatactgcttttaacattctcttttttaaaaattcctttgatgataaggctatttataaaagttaaattaaatccagctgggagcagtggctcatgcttgtaatcccagcactttgggaggctgaggcaggtggatcactcgaagtcaggagttccagagtagcctgaccaatatggtgaagtcccatttatactaaaaatacaaaaattagctgagcatgatggcatgtgcgtgtagtcccagctactcaggaggctgagacaggagagttgcttgaacccaggaggcagaggttgcagtgagccgagattgtgccactgcactccatcctgggagacagaacgagactctgtctcaaaacaaaacaaaagaaacagaagttaaattaaatccagaacaaccctggaagacatagaaaaccacaatgagttacagcaatggcatgagattagaagtagcgagagctgagaaagcagtgggtcaaagctaggcaattgcaagtagaggcaactggaatcagccacactggcttgaccaaagccacacccacacaagatgactggctttctaagattcagttaggagacagactctcttcataggttttctgcactaagaaactcctacgttggactctacagagagaaaagtgtcccgagaggccagaaaacctatgatgacaataagaaacgaaaagatacctgcacaccctacaaaaagccttatttcttctccacagcaacaccttaaatcagtaagaaaacacttatgctcaataacagcataggagtgaaggatgtggacaagaactttaccaaaaagtagcccctaaaacaagtaaagaagattagtccaataatgaaagagggacataaaactactgttattaccattcctactgctgtttggtttaaatttatatttcaagtgtattagtgtctcacattgtactaagcatattttctgcataaactcatttttttttttttaagatggagtctcgctctgttgcccaggctggagtgcagtggcgtgatcccggctcactgagcaagctctgcctcccgggttcacgccattctcctgcctcagcctcccgagtagctgggactacaggtgcccgccaccacgcccagctaattttttgtatttttagtagagacagggtttcagtgtgttagccaggatggtctcaatctcctgaccttgtgatctgcctacctcggcctcccaaagttctgggattacaggcgtgagccaccgcacccggccaccgcataaactcatttaattattgcaacatcataggtattattatctccactttacagataagatcaatgagatttttaaaattatagtatttttaccaacttcttacagcaaaagcatgaaagagtcacagtttggtctgacttcagcatgtttgttttcaatggctaaggtacagttttaaatttccagtttaaaaaataacagtaaaaattgtattgattggattagtaaaatcttaaatgattgataatgtcaatgttaggctattatagtataattttattaaatattttcagccaataatgttaataatttgatgcaactcaattgtgtatcaaaagaggaaaggttaaatacatttttggttattatgtataatgaaatactatgcagccctttacaaatttggggaacatctatatctactgacatgaaaatatattcaggatataatataaagtgaaaaagcgtgatgcttttttaatgtaataagatcatattttaaaaaattatttgtataaatgtatcatatatgtgtgcatatatttgtgagatatatatattctataaagtatatcaaacttctaacagtgtccttttaaaaatggtcatttttttactaataaacttattttttaataacaattttaaaatcatgtatttacctatactttcgtaacataatagaaaaagaaaaaatttagaagtggactttacctagacatagcaagtcgtaatttctatattcaaaagaagaatcaatttgttgtaaaactctctggaaccctcaaactttataaatgaaactacagatgcttaaaatgtaaataacaatttgtttttacttttatttttgcatgtgcgttaatattttgagggattctcaataataatatataaaagttgtctaaaatgtgatcatatttacattgttcttacttagaaaaatattattttctgtttgatttagaagtgatagaaagggagtgattttgacagcagttagcctagatgacaactgtagcattttatagccactcatttatttgaccttctagaatatcttattgttgcaatggttcatgtgagattacaagtttaagatgtgactagtacttggtcccactgcaatgaaggaagcttttctctacaagaatgtgccacctgtagcaaaatcttcattggtgttactaccgtaggtaatgctataacaaaataccacaggctgggtagcttagtcaacaggaatttatttcctcatagttctggaagctggaagcttgagatcaaggtgttagcatgattggtttctcctgaggcctctcttcttggtttagtgatagccactgtctctgtgcctatagagatttctggtgtctcttcctcttgtaaggacaccagtcctatcagattagggccccacccttctgacttcatttaatcctgttgtctcctcatacaccctatctttaaatacagtcacattaggtgttagggctttaacatacaaattttagggagacacaaacatttagtccataacacaggccccatgcaaattggaagatacaatcagaaaatctccagaatgggtattaaaagcatctcagccttagctggctaacactcttgactttgaagaagtgtaacagtaaatgtcaatatcattgctatggttctgctccaaatttcacgctgccttcttatcttcaaattcaaaatgagagaaaaggtcaaaaatatttcaagatatagtatactgaaaagatacatttttaaaatattcaatggaattccttcatttttttctttctccgctttcctaaacatatttaatttcttagctcccagaaaatcattgtttttaggtatttcttagagttttctgacactcttcatgctcaatttgtgttctaatacatataattatttttcatacaaatgattaaaaatttgctcaaaagactaaatttaaaaagcaaatatataatttttatccatttgttaacttattttcaaagtaatgtgtcatttgaattcaactagttttgttttcttttattttgttttttaatgtgcttgcttgattggttaaccactgcatctgtgcagacatgaaagacagaagaaattgaagagggcagaataaaaaccattttacatgtcctagaatttttccagaaactctaagagatttgagtaggagagaggcagtgtgtatttgtattgcttggaagcagctgcagtagcaaactgaaacaaagcaagtcattctctgtctcttctcagtatgtgaaagcaaataaatttttttaaaaaaaagatatagcttgtggaaaagagtctattctgttctcctcattattttagcaagaggtatcattttctctgtggtgactgtgggagtgtgaccgtgaagttatctaccacgtctcattacattttagcttaataggaatatggataatttcagccttgctaccaggtgattgtaaatgtgctgattatctgtgtctcctctgaattggtaagagtacagtccgctccatcacttgttttgtttgtcaggaggaagaaatttttttgtggaccctgtttaagctaagttctaatagaattagaatgccagatcttattaaaaaaaaaaaactggtcgtatcagagattaatgtatcctccatactaataaatttacaaaactttaataacagccaacgtaaagtacattagaatttttctcaacacccaaattatgaaagtatacatgtgattgatagtaaacatgtttttattttttatgtttcctgcctagtaatttatctacaaaacaaacatttataatattacttcttaggctttttgaatgctaatgacattttagaattcacatctcctcttacaattcaaaacaggggcacatttagtgctataatgtatttaaagtgctccttttagaattgtcctatgtggtaaagatgataatgttccctgctgatcatcatttgttttaagctaagagaataaatccaaatttttaactagatctatccttttctaaactttcaagtgaatttcagactcaaagataacagtcctgcaatctgccatgatcactgccactgctccagcccatagcacagtgcctggcatacaatataaatatgtattgaacaaataaataaatgaatgaatcaccctcataacctttctcctctgcatttgtttcacattggccaacactaacataaaacaccagataaattttaagtgaagtaaaacaatctagtggttcccaaatgctagcaaataaaatagactaaggtaggtcaagataaacctgaaagaagacaaatcctagagaaattcagtgacacagacaaaaacatgtatgcaaactttaaaaagaatatatatgaataaatcattgtgcttttaaataaaaatgcacttccacaagcaaatagtcacacaatgatgaagtggtatttctaaagttttatgcaaagcgtttttcttgctctctacctgttcatttacccaaaggcatttttctcttattgaaaattcacttacagcacagagttcattcaggaaaagaatcacagctcttcttatgtgatacagaaactgtgaactatcttgtgtcacttttgttttaatctatgtggacatatatagttgtctaggaagagagatggaggccaatgataataaaaatgatgccacatggatgtatgcttcagctttccctacaaacaacaagccattccaatcctggctctggattcatttatttattgtcaacactcatttttggtttattgttttgttcatcagttccttcgtcacccagtcgcttgttttgtgcctccaagtctcagtcaattcatacgaatgacttgaatgcccccaaatcaaacgagttttgaacctgattacctcctccactcttggctgcagaggttgaaatattatagtccttcaaggcataaaccatgtacttcaaataggaagcagttatgtgccttagtagctgaccaagtgaaaagtgtctgtgagcccaaatttattccaatatttgtttttaggtagtattttgcaagatttctaaaatgcagaattctaagttttctaatagcaaagtaatttaggttggcttactttatatcgatctgttctttttttatttttttattgtttctattaaggagaccagaaagaaaatgcagcatttcaaaatgcctgttcttccccagtgatgggaaaggagggctgcgaggggggggaaggacccagcatgctgcaagcacacaggcatggcgcaggagcgtcaaaacaaggcagcagtggctactcagtacctctgcccattcacagtgggatgcagctttttgatttagacacattaaggctgctagtcttctctgagggtgtggaaatgaaatatatgtttctgggttcctggttctggtaagaatcagacagcccaggcttaatgaagggtctacctacagccagacactctcagagagccagacctctggccagcaaaggcaaactccagggtcccaatgccagtggctacagcagtactctcattagctgcagaaagatggtgccttcattgtcactgatactgagaatagtgaggagggtgacaggcaggcagaggctactgttggaataaatataaagcaatgagatcgtctcaaagaaaccacaggaacaaatgatgttttgtttcgatagcatggggaagaagctacggacaattctgacagaatgtcatttattgcaagtgtgacacatttgtttgagtgtgagggaaagaaagtcaactgttaattttctgctaatgaagagatggatctagaaatgcttctaggagtctccagaaacctgtttctcctactcctaaaactaaggaagctgacattgattttcattattgagactgtgtgccaggacaataacacaatgtgtatgccacctctcacctccattaattctcacatttgtatgcaaaagatgcaaagatgcaaaatgttttataaatcatgagacccagaaaaaacaatctcgttatgggggaactaaaatcaaaatatacaagagttgtttcaactactttcttgacagtatctagttcttcagatggtcaagaaagaaagctctcagaggccagaaaacaatccatgataccacagtgctcagatgcatgatttcagtttactcatagcatataaacgacaaatgcttctttataattcagtcagagttcaactaaagaagcagactcaagaagtagtatatattaaaggacctactacaagtaatttgctttacacgattgatttttgtgtccaaaatcagtcaggtgtgtgctcaggaaggaaagatcaaaagcaggccggaaccctgtaagacccagctgaggctttaaggccaaaggtgatcagaaaagaaggaaacagcaggctgaagcccaaggaccatgagatcaggaaaggcctgaagctgcctgagaaggctcacttgcttggatgatctccctttagattaatttagggacttcactgaaatctgcaaaatctcttcacagcagcaactagactcctgttttactgggtagtttgtaactgtagctcagcctagctaaattgcccattacaaagttatcatggcagcgattgtccttcctgctttgaaaatacattaacacattcttgagagtacacctgattgtacattctaaaacaattttttaaaaacttctacaataaaaggcagttaaaacacttcccaccatttcctgtctgggggttacatgggggctggtgcgctgagcagttggaacagactccaggaacgctcctacattcagatggagggtgagaacagataagctttgacactttcaagtagacgttctgtgctagcctgctctctaatgacttagcacgtcatcagaaatggctataggaaaaagtgccaagttttagtctaaagattcttgtcgaccgggcgcggtggctcacgcctgtaatcccagcactttgggaggatgaggcgggcggatcacaaggtcaaagaatagagaccatcctggccaacatggtaaaaccccgtctctactaagaatacaaaaattagccggggatggtggcgggcgcatgtagtcccagctactcgggttcaaagagaatcgcttgaacccgggaggtggaggctgcagtgagccgagatcgcggcactgcactccagcctggggacagagcaagactccgtctccaaaaaaaaaaaaaaaaaaaaaaaaaaaaaaaagattattgtctgccaacaagaaactcagaacacaagtgaacacagttctctggctgacacgccttcccttcagcgcaggatgagtggtcactgaagggaagctgcagggagactggggccacgatggaattccatcactcacagaccatgctcatcatgtgataacataagcaggacttttatacaagagttgggcacccctctcaccactgatttttttttgtctctttttttgtgtgtgttacaagaggagagaatttttcttcttttattttcttttcctttcttttaacagttttacaaactgaagtcaagagtactttcaatcaggtctcccacagggaaagaaaaaaagccaatggaattaccagagccctttcttctcttttctcttccaggtaggagggagggatcccaaggctatgggctgggaaaatgagtaagtaaaaaataaactaaatgcaaggaagtgggagggtactgcaagggcgaagaaagaaattaaccatacctttttcttttactttttcttttttaaccttatggtttaaatataaattgaaggtcttgaataaatttggaaaggaaaagaaacaccattctctcaaagtacattaaaggtataattattaaaaaaggaaatggaactaaaacatgtcagatttttaaccttttctttacattttatctagacatctttttactagaaatattgtagaaagttaatacttgccccagcaaatgccaagcagtggcacctgtccattttccatagaatcctactttgtgaagcaccaaaatgcccggctctgagtttctgcatacactgcccagaaaccactgttcagattttaagccatagtttgctttcttccattttttaacactttggggttcttatacaacattttatgagccatggagtatgcttcaggtagatcatccagaaaagtacgtggggacactgttgtgggggtgttagacaatttatgagacatttattgcttggtcagcatgaatttctggcattcagttttgagcattagttgctgatagattagtcttgcccttttaatcagggttagcctaatcaattgtcattttaaatgtgactttgaatagttcaaatgggtacactaccaaaaagtataatttgattccaatggtctctgtatcgtgtggagtgatgtcaggaacaagctcaacaagaagtcaaaaaataaatgtcatcatctgaaaatggaagtttttcaccccacatttacaggtttcttcaagttccttcattagtctcttgcagatccctatcttagagctaggtccctatcctatttactatgcctttgctattcatgtttagtctgcattttaaacaagcataatacaactatagtttatttgttttggcgagtcccagggtatcatgcttaaacatcacttgtaagacatgagaatagtaatagaactgtgttttcaatctatggtttgtacatattcgaccacacagaattcaatgttaccttacagacttccttggttaaatgaataatagaatgcaaaaataatacagaaaaaatattatatttatactttagatttcaaaaaattcaggttcttaattttggagtacaactaggactaggatgcattgatttggcttactgtgaacaaagaattgtgtatcctcaatcaatactgttgatgttgttaaacacccatgtttgtttattggctcttcactgtaacctttggtgacaatgataagatcttgatcacagaaatgtagacatctttaagcagctacattctatgtacttaaaactagtggatttttcccatctgggaagatgtagtcaaaatatttgtctcaatttttcttgctaagtacaattaaaaaccctgaacactgtacatagtacaaccacaagaagattctgaacggtggggaaaaaaaaagactgactgacaagggacagtcagcctagcaagccagaaaacttttaaacaatgattgctctactacagccaaataacacagaaaacattatggccagctgaacctcagtgggtagtctaggctttcatcatagccgggttgtaacaaagagtcccaactcccctttcccatccctgctaccatcaaggtgttatcagataaggccaagtgaaaagctgatattttcatccctgctgggagggtaatgagacgccctttcaacctcagtgttagtggagaccatgtgaagagcccagatttcaacccagcagtacaaagatgcccctcccttttccttctacggtggtaccacgggaggcatagtgaagagtcaggacctccactactatctagtggatagttcccatggtggacagagggtgtagcaaaaagacactacgcatcacagccagggaggtaacagtggaggcctagcggaaagccagaactcctgtgttcaagcagttgtcagtgagtgtttgaacccacctcaactgtcaattgtggccaaatggggggcctacacttctgcccacatctggtaataaaaaggcagcacaccagtcttccccaaccagaatggcatcagagaatacatgctcaaaaagatttaagtaaaatccagagactcaaaacataatctacaaaatgtccacatttaaattgcaagttacttgtcataccaagaaccaagaagaactcaaactgaatgaaaaaacataattgaaagatgccaaccctgagatgtcagagtgtaaaagtatctgacaaaaattttaaagcggccattactaaaataatttaacaattactattgtgcttgaaaccataaagaaaaaaatagaaaaatcaaaaaagaaccaaatgaaatttataaaactggaaaatatatagctgaaaggaaaaatagaaaatgaaaaagctttcgttattggctcaacaacagaaaagatgagacagaagaaaacatcattgaacctgataaatgaaacaatataaatttcctaacctaaacaacagagaataaatggaaattaagagagagagagacagagagtgcaaccatggcctcggggatctatgggactatacaaatgatacaacattgatgttatgagtcctgaaggaaaggagaaagacagtggggttaaaaatgcttacacctgtaatcccagcactttgggaggccgagacagtcagatcacctgaggtagggagtttgggaccagcctggccaaaatgctgaagccctgtctctactaaacatacaaaaattatctggctgtggtggtgcatgcctgtaatcccagataactgggaggctgagacacaagaattacttgaacctgggaggtgaagtttgcagtaagccaagatcatgccactgcactccggcctgggcaatagagtgagactctctatcaaaaaaaaaaaaaaaaagtaatctaaattaatggtaggaaatttcccaaagtctgcaaaagacatgaacctactgattcaaaaaagctcagtgaatccttaaatgaataaacccaaagaaatctacacttggacacattgtagtaaaccttctaaaaactaaaggcaaagaaaacaatgagagagaaacaataccttactagcaagtgaaaaacatgtcaaatgacagtagatttctcatcggaaacaatgtgtgccagaaggaaatgccagaatgtttttcaaatgtttaaataaaagaactgtcaactcagaattctacctccaggaaaatattattcaagaattaagacgaaaatcaaaaccttttcctattttgatgaggaaaaatgaaaagaattttgaaaagaatttttttgccagcagaactgccttaaaagaatggctaagaagttatttgaacagaaagagaataattaaagaagaaaacttagaacaccagaaaggatgaaagaacatcataagcaaaaatatgggtatataaaatatactgaatttcaatacatatttttcttttcttgagttttctaaattatgtttgatggttaaagcaaaagttatcacattgtctaatacagttctaaatgtaaatagagaaaatattaggcaattatttataagtacaagaagatagagtgacataaaaaggaggtaagatttctgtgcatcaatttaaagggtaaaatggtaacaccagtagactatgatatgctacgtatataatctgatatatagaacaaccctaaaaagggttacacaaagagatatgaaaccacctttgcaaaattataactgaggaaattatgacagtgaaagaaatcggacttaatcgactccatcttgcttctaacatttaagctgcccttgttcattcctgggcataggctgaactttgggaaggaattcagttcatagtttaactctgaaacaaaattgacaacagccctttcccaaaaagaccactttcttgcctgggggccagtctgcctttgcaggactaacacattagctccaagattagaaattacagtttaggggtcatgcagcctcttgctccaagattgtgaacctccccaaatcgctcttggggataacgtcactattgtaaaacctaagatcactgcttgagatatctcgcagaccctgcactggatggatcagctgacacctctcccagacgggtaatctggcccaaccagttctgccatcccactcaggaacagaagacagcaagaaaacctcacttggacctgctatgattccatctccaaccggaccaatcagcactccccacttctcaagcccctaccctccaaattatctttaaaaactctgatccccgaatgctcagggagagtgatttgaataataaaaaaattcctgtctctcgcacagccagctcttcatgagttactccttctccattgcaattcccctgtcttgataaatcggatctgtctaggcagcaagcaaggtgatcccactgggcagttacacatagactcaaaaacaccatacatatggccaggcacggtggctcatgcctataatcccagcactttgggaggccgaggcaggtaggtcacgaggtcaaaagattgagaccatcctggtcaacatggtgaaaccctgtttctactaaaaatacaaaaatcagctgagcgtggtggcgcatgcctgtaggtccagctactcaggaggccaaggcaggagaactgcttgaacccaggaggcagaggttgcagtgagccgagatcacaccactgcactccagcctggcaacagagcaagactctgtcacaaaacaaacagacaaacaaaaatgctatacatacatcaaaataaaattctaaagaaaatatttaattaactcacagtagagcaggaaaaagtaaccagacagataaaaaccaagagacaacaaagaaaatgaaaagcaaaattgccctgtaaacaattacattaaatgcaaatgtcttaaaatacagctattggcataacaaattattaaacataaccaagtatatgctgtctacagtaaactcacttcaatataaagcagtttgaaagtaaagggatggaaaaagatacattatgcagatattaattgaaaggaggaatggctatgttaacattagataaagtatatttcaaagcaaagaaaatattttataatgataaaagaatcaggccgagtgcagtggctcatgcctgtaatcccagcacttagggaggccgaggcaggtggataacctgagatcaggagttcaagaccagcctggccaacatggtgaaactctgtctgtactagaaatacaaaaattagccaggcatggtggtgcatgcctgtagtcccagctacttgggaggctgaggcagaagaatcacttgaacctgggaggcagaggttgcagtgagctgagatagtgccactgcactccagcctgggtgacagagtgagactctgtctcaaaaaaaaaaaaaaaaaaaaaagaatcaatccaacaaaaaaaaataacaattctaaacaagtatgcaccaagtaagacaggtacaaaacaggcatgcaccaagtaacacatgctgtgaagcaacagtaaataaaactaaaataataaaaggaaacatttacatttatattaggagatatcaacatccttgtcccaacaattaatagaacaaatagacagagaatcagaaaggatataaaactcaataacaacattaactgacagaatctaatgaatatttatagagcacttcactgaacaacagcagaagacgcattattttcaagtgcccccagagcatatgccaaattacaccatatactgggacataaaacaaacctctaccaatgtaaagaattaaaatcacagacgttgtgtcttctgattacaatgaaatgaaactaaaagcaataataaaaagataatagaagaatttccaaaagcttggaaactaaacaacacacttctaaataatacatggctcaaataaaaagtcttaaaggaaattttaaaaataaactgagctgaactaatttgaaattataacacatcaaaatttgttgaacacaggccaggcgcggtggctcaagcctgtaatcccagtattttgagaggctgaggcgggcggatcatgaggtcaggagatcgagaccatcctggctaacatggtgaaaccctgtccctactaaaaatacaaaaaaattagccaggcgtggtggcgggtgcctgtagtcccagctactcgggaggctgaggcaggagaatggcgtgaacccaggaggcagagcttgcagtgagccaagattacgccactgcactccagcctgggtgacagagcaagactccatctcaaaagaaaaaaaagaaaaaaaaaaatttgttggacacagataaagcattgatgagagggaagacaagcattaaatgcatgtattattcaggaaaagcctcaaatcaataatctaagctcccatttcaagaactgagaatagtgacataagctaaaagtaagcaaaaggaatgaaataataaaaataagatcagaaatcaataaaactgaaaaacagtaaagacaatctaaaaacagctggttctttgaaaatatgaataaagtaggcaaatctccagcaagactaagaaaacgaaaacgcaaagcactactatcaggaatgaaacaaaaaacatcaccatagactctactgacatgaaaaagataataatcgaataccaagaacaatttcacacatataaatttgacaacttagatgaaacagagttattcatcaataaaacaaaatagaggaaatctaacacaactcattcagtaagaaatggataatttaaatcattctatagcttctgtaactattaaggaaactgaagtcataaattaaaaactcttaaagaaaaaaataattactattttcagatagtttcattgtagaattctagcaaatgttaaaaaaaatcaattctacacaatttgttccagaaaaatagatgaggatacagaaaaccattcccaatttattattcgatgctactattaccctgatacaaaaaaacagacaaagaccatgcaaaacagaaaactgcagatgcacatccttgtgaatatagatgcaaaatccttaacaaaatatatgtaaatataattcagcaatacgtaaaaagaattatacacatgacaaagttaggttaatttcaagtataaaagtctagttcagaatttgataatccatcaatggaacccaccatattaacagacaaaaaaggaaaatcatatgatcatatcaatttatgcacaaaaatatttaacaaagttcaaaactcatttagcatttaaacagaaaaactctcagaaaaatagggccagaagggtactttctcaaccagttaaagagcagctctaagaactctatagttaatattaggcttaatattaaagactcaacacttttctcctaagatcaagaaaagggcaagaggccaggcacagtggctcacgtctgtaatccccagcagtttgggaggccgaggatggtggatcacctgaggagttcaagaccaacctggctaaaatggtgaaaccctgtctgtactaaaaatacaaaacttggcagggcgtggtggcacatgcttgtagtcccagctactcaggaggctgagacaggagaattatttgaacccaggaggcggaggttgcagtgatcacaccactgcacactccagactgggcaacagagcaagactcttgtctaaaaaaaaaaaaataaaaggaacaaaaagaaaaaaaaagagaagagaagagaaaagaaaagaaaaaagaaaagaaaagagaaaagaagggcaagaatgtctgctctggaaatatgagccagtttgataagactagaagggaaatggaaggcacacatatctgaaagaaagaaataaactctctatttgcatatgacatgatgatttacataggaaatcccaaggaattaacaacaacaaaactttggtaagtaataaatgagttcagtaaggttgcaggatacaagatgaacatacaaaaataaaccatcatgttatactagcaatgaacccatgtacaatgaaattagtaaaatatcatttcccatgattctaaaaataatgtaatacttaggcataaatctaataaaacatgcacaggacttgtacgttaaaaattacaaaatgctgaagaaaaaatcaaagatgatttaagtaaattgacagatatactatgtttgcggactggaaaatttaacatagaaaatatatttattctcctcaaatttatatagaagtttaacacattaccaaaaagatcgtagtaagacttttttgcagatatagaaaacattattctaagatctataaggaaagaaaagggaactagaatagctaaaacaatttggtgagggaaaaaagaataaaataaaaagaacccatcttctcaatatcagggatatacacataggttaacagactagagaagtcagaaatagatgcacacaatatgtcaaagtgatttttgacaaaagtgcaaaaggaatccaatgaagaaaaattagcttttaaaaaaaatggtactagagcaagtatacctccataggcaataaacaaacagaaaagaaaaaaaggaagaaacttaaactaaggatcacaacctataaaaaactaattcacaatggatcatgcccttaagtataaaaccataagctttctgggggaaaagaagaagaaaatcttcagaatgtagggccagagagttccagactaaatatcaaaagccaaatctataaaagaacaatatgataaattagacttaaatctaaaatattttactctgcaaaagactttggaaagaggatgaaaagacaagatatagatgatagatagataggtagatatagagatataggagatatatatttatatatagaaaaatatatatagacatatgtagaaaaatatatacagaaaaagtatatattatatatatatatatatatatgtgtatatatacacacatacacagttgagacaacgtctctttctgtttctgtcagccaggccagactgcagtgatgcaatcatggctcactgtaatctcaacctccaaggcttaagcaaccttcccacccagcatcccaagtagtgagactacaggcacccaccaccatacctggctcattttttaaaaaattttttgtagagacagggtctcactatgttgcccaggctagtctcaaattactggcttcaagcaatcttcccaccttagccttctaaagtgcttgaattataggcatgagccactatgcctagtaaaacatgattgttaaaaatttacaaactatatatctgaaaaaggactagtatctagaaaataaaaagctctctcaaaacttaacagtaaaaaatggaagcaattcaatagaaaagtgggaaaaagatatgaaagatatttcactgaagaggataagcagatgacaatgaagcacttgttaaaaagttcaacatcatcagctgttaaaagaaactgctaactgggccaggtgcggtggctcacgcctgtaatcccagcactttggaaggccgaggtgggcggatcacggatcacgaggttaagagatcgagagaccatcctggccaacatggtgaaaccccgtctctactaaaaagagaaaaattagccaggcctggtggtgctgcacgcctatagtcccagctactcgggaggctgaggcaggacaatctcttgaacccaggaggcggaagttgcagtgagccaggatcgggccactgcactccagcctgggtgacaagagagaaactccgtctcaaaaaaaaaaagaaaataaaaacaacaacaacaaaaacaaacaaactgctaactggggtggtgccaggatggctgactagaagcacccatgatcggaggctcccatcaaaaagaaccataattagcgtgtaaatcctccacctgcaaccaaggtatcagggttctctcagtagaactgacaaggtggctgacgtgatccacagacaggaagcaagagcagtgtggtgtggcagcccaactgagagccacacagggtagggtaggggaggccccacctgcaagccaagggaggttgtgagtgaacatgctacccagccagggaaactgtactttttccacacgactgtgcaacccgtggatcagaagatcccacttgcaaacccatgccaccagggcctaggatcccaaccccagagccacgcagattctcaacagcttctcagctagaatctgcttaagcctgctgagttcccgaagggaggggtgaccagcaccacacctccagccacctgctgtctaagctatttgagctccctgggggaggggcagcagtcagcattgggactcctaagtacctaacacgctaaactccctgggcgggggaagggtggcatccatctctgtagctccaggttgtgcttttcccctgctggagccagggaggctgatggcttggtcccagcccaccacaccagctgtggtagactgtggccagagcacctcttcaggcctgaccctgacccatccttcctcacagggtgggggatccttacaggaactccaagaactccagccagagcctcagagacagaatccggatctccttgggcctgagcccctgaggggagggacatcggcagtctttgtggaccagtagacttagcttttcctcctggtagttctgaggaatctgggcagctcaaatgagtgagtttccccccaggcaaagcacagcccctccaccaagggacagtcaaagtgcttcattaaatgggtcctgctccccatgcaacccgagtgagaccctccaacaggggttgtcagataccctatacagtaacgatcctactggcatcatgttggtgctcctcaaggtcagcaatcccagaagaagtatcaggcacccatctttgctgttctccagcctccttgagtgacacctgcaggcgtgggagcaaaccagatgaatagggcctgaagcgaacacccagcacaccacagcagccctacagaagaggaacctgaccattgaaagaaaaacaaacaaagcaacaacagcaacatcaacaataaagaagtccccataaaaaacccatccaagaggcagcagtctcagagattgaaactagacaaactcatgaaaatgagaatcaataaaaaaacgctgaacacccaaaaggccagagtacctcttctcctccaaatgagtgcactgcctctccagtaaggttacagaactggacagaggctgagatggatgaattgacagaagtggcttcagaagatgggtaatgaaaaacactgctgagctaaaggagcatgttctaatccaatgcaaagaagctaagaacgtcgataaaaggctagaggagctgctaactacaataatcagtttagaaaggaacataaatgacctgatgaagctgaaaaacacagcaggagaacttcatgatgcatacacaagtatcaatagttgaactgaccaagcagaagaaaggatatcaaaagttgaagactaccttgttgaaataaggcagaagataaggttagagaaaaaagaatgaaaaggaacaaacaaagcctccaagaaatatgtaaaaagaccgaacctatgattgactggagtacctgaaggagacagggagaatggaaacaagctggaaaacacactgcaggatatcatccaggagaacttccccaacctagcaaaacaggccaacatgaaaattcaggaaatgcagagacaactactaatatactacatgagaagatcaaccccaagacacataatcatcagattctcccaggtcgaaatgaaagaaaaaatgttaagggcagccatagagaaaggccaggtcagctacaaagggaggcccatcagactcaaaataaaggatggaggaaaatttaccaagcaaatggaaagcaaaaacaaagtaagaggttgctatcttagtttctgacaaaacaaactttaaaccaacaaagatcaaaaaagataaagaagggaattacataatggtaaagggaacaattctacaagagctatcttaaatatatatgcacccaatacaggagcacccagattcataaaacaagctcttagagacctacaaagaggcttagactcccaaacaataatagtgggagaccttaacaccccactgtcagtattagacagatcaacgagacagaaaattaacaaggatattaaggacttgaactcagctctgaatcaagtggacataatagatatctacagaactctccaacccaaatcaacagaatatacattcttttcagtgccacatggcacttactctaaaatggaccacgtaattggaagtaaaacacccctcagaaaatgcaaaagaactgaaatcataacagaatcatagaccacagtgcaatcaaattagaactcaagattaagaaactcacccaaaccacacaattatgtggaaattgaacaacctgccctgcatgactcctgggtaaataatgaaattaaggcagaaatcaataagttctttgaaaccagtgagaacaaagagacaatgtgccggaatctctgggacacagcagtgttaagagggaaatttataacattaaagcctacatcagaaagctacacagatctcaaatcaacacactaacatcacaattaatagagctagagaggcaagagcaaactaatccaaaagctagcagaagacaagcaatcactaagatcagagcagaactgaagaagataaagacatggaaaaccctccaaaaaaaaatcaatgaatccaggagctgttttttttttaaattaacaaaatagataggccactagctagactaatgaagaaagagagaagaataaaacagagacaataagaaatgataaaggagatatcaccactgaccccacagaaacacaaactactatcagagaataatgtaaacacctctattcaaataaatgagaaaatttagaagaaatggataaattcatggacactcccaagactaaaccaagaagttgaatctctgaatagaccaataataagttccgaaattgaggcagcaattaatagcctaccaaccaaaaaaaaagaccaggaccggacagatccacagccaaattctaccagaggtacaaagagtagctgggaccattccttatgaaactattccaaacagctgaaaagcagagactcctccctaattcactttatgaagccagcatcatcctgataccaaaacctggcagtaacacaacaacaacaaaaaaacttcaggccaacatatctgatgaacatcaatgcgaaaatcctcaataaaatactggcaaactgaatccaacagcacatcaaaaaacttatccaccatgatcaagttggcttcatccctggtatgcaaggctggttcataatatgcaaatcaataaatgtaatccatcacataaacagaaccaacgacaaaaaccacatgattatctcaatagatgcagaaaagttctttgatgaaattcaacttcttttcatgttaaaaactctcaataaactagatattgatggtacatatctcaaaatattgagctatttatgacaaactcacagccaatatcatattgaatgggcaaaagctggaagcattccctttgaaatccagcacaagataaggatgccttctctcaactccttttcaacacagtattggaagttctggccagggcaatcaggcaagagaaagaaataaagcgtattcaaataagaagagagaaagtcaaattgtccatgtttgcagatgacatgattctatatttagaaaaccccatcatctcagcccaaaaactccttaagctgataagcaacttcagcagtctcaggatacaaaaccaatctgcaaaaattacaagcattcctttacaccaacaatagacaagcaaagagccaaatcatgaattaactcctattcctaattgctacaaagagaataaaatacctaggaatacagctaacaagggatgtgaaggacctcttcaaggagaattacaaaccactgctcaaggaaataagagaggaaacaaacaaatggaaaaacattccatcctcatggatagaaagaatcaatatcatgaaaatggccatactacccaaagtaatttataaattcaatggtattcccatcaaaccaccattgacattcttcagagaattagaaaaaaactactttaaatttcatatggaatcaaagaagactccatataaccaagacaatcctaagcaaaaagaacaaagctggaggcatcatgctacctgacttcaaactacactacaaggctacagaaaccaaagcagcatggtactggtaccaaaacagagatatagaccaatggaacagaacagagacctcagaaatgacaccacacacctacaaccaactgattttcgacaaacctgacaaaaacaagcaatggggaatggatcttttattcgataaatggtgctgggaaaactggctagccatttgcagaatactgaaactggaccccttccttacaccttatacaaaaattaactcaagatgattaaagacttaaatgtaaaacccaaaaccataaaaactctagaagaaaacctaggcaataccattcacaacataggcatgggcaaagacttcataagtaaatgccaaaagcaaatgcaacaaaagccaaaattggcaaatgggatcaattaaactaaagagcttcttctgcacagcaaaagaaactatcatcagagtgaacaggcaacctacaccacgggagaatatttttgcaatctactcatctgacaaaggtctaatatccagaatttacaaggaacttaaacagatgtacaagaaaaaaacaaacaaccctgtcaaaaagtgggcaaaggatatgaacagacacttctttaaagaagacatttacacagccaacaaacatgaataaaagctcaacatcactggtcatcagagaaatgcaaatcaaaaccacaatgagatctatctcacaccagtcaggatggcaattattaaaaagtgaagaaacaatagatgctggcaaggctgtggagaaataggaatgcttttacactgttggggggaatgtaaattagttcaaccattgtggaaaacagtatggcgattcctcaaggatctggcgccagaaataccatttgacccagcaatcctattactgggtatatacccaaaggaatatgaatcattctgctataaagacacatgcacacatatgtttattgcagcactatttacaatagcaaagtcatggaactaacccaaatgaccatcaatgatagactggataaagcaaatgtggtatatatacactttggaatactatgcagccataaaaagggatgagatcatgtcctttgcagggacatggatgaagctggaggccatcattctcagcaaacacaagaacagaaagccaaataccacatgttctcactcataagtgggagttgaacaatggtaacacatggagacagggaagggaacaacatacaccagggcctgttgggggacggggttgaggggagggaacttagaggatgggtcaataggtgcagcaaaccaccaaggcacatgtatatctatgtaacaaacctgcacattctgcacatatatcccagaacttaaagtgaaaaaaaaattaattaatttttaaaaagaaactgctaagacaaaaatgtgatatcactacacacatagataattgtttaaaataaaaaatagtgacagcacaagaatctggtgaggatgcagagatgttggatcactcacgcattgctgggggggatataaaatggtacagctattctggaaaagtttgtcagtttctttaaaaactatacatgcagctactataccatcaagcaattgcactcccaggcatctatcccacaaaattaaaacttatgttccaaaaaaaaatctatacatgactgtttatagcagagttattcataatagccaaaacaggaaacaacttagatatccttcaccagctgagtgatcacactgtggtaaaaccataccgtgaaatgccactcagcaatagaaaaggaatgaactatttattgatgcacacagcaacttggatgaatcacctgagaattacgctaagttaaaaaaattaattacattgtaattaatgtattacattgtaaacaatgaaaaagttattgttttcttctatctatataacattcttaaaatgaaaatattatagaaatatagaccatattagtggttgctaaggtttaaagagggtgtgtggtaggagagaagtagatgtggctataaaaggacaacttgataacctcgtgacgatggaaacgtgtggtatcctgtctatgtatgtattatacagatagctgtgagttataatggttcaatttacgactttttaaactttccaatgcaaaagtgttactcattctgtagaagccatactttaaattttgattcaaaattctttaataataactttataaaacaggctataaaatagcctataaaatacactttgtgttagatgattttgcccaattataggctaatattaagtgttccaggcacatttaaagtaggttaggctaagctatgtttcataggttaaagtattaagtgcatttggacttactatattttcaattgatgataggcttatagggacataaccccaccacaggtcgagaagcagtatgttgtaagttgactatatctacttcaatatcttgattacgatattatactctagatttgtaagatgttctcattacgaaactgggtaaggaatttatggcatttctctctattatttcttacaactatatgttaatccacaattatttcaaaatgaaaagtttaatttaaaaaaatttacttggaaatatatatattacctgaaattttcatcttaccatatgcttctaagagctgtttaatggagaaagtaacacaaaaataaaaacaatatattacctacgtttagtatattttattcataaatattcctttgcaaacatcttatttgttcccatcatggccaaataaaattatagaagcaggtcatcattcccattttaaatttggtgaaacaggcaaagatttataagaatttcccaacgtgaaaaggctactaacttactaagtttatgagacagcaaagctcttaacatctctagttaagagcaaacttgaaagtaccactgtctccatggaaatgtctcaggaccatcactggagataatcaatgggctctgtgtgatatttgactaaaagatttgctgctaaaaatatactacaccataatgtactaaaaaggggaaggaaaggctgctgtttcctgagatttctatattgggaagctttaattctagcaaaaataatagtcatgtcaaggaccctgctgtggtgttgacaatgcttgtcttgcaaacacatgtcataataaagatctgcctgcacctggtcagctttgtaaatactgaggaaatacttctccttaaagtcatgcattgttcaaaaacttaaatttcaaaagggaaaataaacaacattataaattattgctgcttagattatagaactgtagattctaaacactggcttcatggcagccatgtggggactaacgggacatcatatattccaagtcttaatgctgatctatccttgtgcctttttactaaactttaacattaataacaaggagcattttcaaatactcacaaagaatatctagagcagaaaaaataaacagctctgttctaaacctataaagagcatactgaattcaggctctataatatatgaaaataaatgcaacaagaccaatttatttccaaagaaatgttaaatccgaattaattttaaaatgtttagtaataatagcagctaatgtttactaagcacttactctgtggtagatattgttctaagcactttaaatgcattaagatatttagttctcaccataatcctatgtggtaggtactattatcatctatattttatacttgaggaaactgagagaagcaaggacaataagctttcccaaccatttgggagccaatattcaaacctaggcagtctgacaccagagtctgtgataacaaccactagattaagaggaaggagaatgcctttcacaatccattatatttcattagaatgaagttcaaaactgtcacaacaattaaaaatcgcctgttattatgtaatattatttacatagaagttaatgaagtacagaaagtgtaacagttgccaaatgacacaggacacatgctataattttttaatcatgcacaccaagagcaatggatgcaaggtgcaaagagattttggttacactaaatagataattggtttgaaatgaaaaacagtaacagtcacagtaccctagaaagaaagctatgaagctccaagtgacttccatgccactctcatcactaaacacacaaagaacccgtgttcctgtaagagtctgccatacctgaatgaacagcccagaattaaagcccagtttataggcaaaaatgtatagggcagatagagttttctgagattgcctggacaataattccacccctaagaaaaaataactaatacaactacgcagatgtcttctcttgggcatctgaatgtgcccaagtttctcttggggatgtgaaatgtgagccattaaaaaataaaggtagttatctggtatttgagtgaaagaaaaaaagggttccaaaaattgtattagtttcttattgctgctataacaaattactccaaatgcaacgggttaaaaacaacacaaatttattcttactgttcgggaggtcagaaggcccactggggttcactgagcaaaaatcaaagttttggcaggattgcgtccttctggggatgctaaggggagaatgcattctttgtctatcccagggtctagagacgacctgctgctgaatcccttggcccgtggcccactttcagcagtggcatctttggatccctgcttcctttgtcatgtctccttgtcattcattgggctcacccacgtaatctagaattatctccttatcaaaaattcttaatgtaatcatatcaacaaagtctcttttgtcatttgaagtaaacatattcatagttttggaggaataagaatgtggacatatttaattggcggcaggtggcggggcgggggtggttttgtcctggctaaaacaagcagagtgtagtaggttaagagctcagctctataaccctctgagcatgtgaaatcccaccaccaacatatacagctgtgttacctctcaggtaattacctaacccctctctacctcccttttttcatcttgaaaaggggaatcataatagtatccctctcaggaatttgagattaaatgaaagaatacatataaaaagcttagaacagtgattggaatatagtaatcagcagagaaatgtaatctcttaagataagaaacaaatataatatttaatgttatccctaagatgaggaaggcatagggagatctgagaaatgattcacttctaaggcttgtcttctgtccttaacactaccccaacttcctttgagaactggccattttcttgcaaagttggtttcttacactaatatactaagacaaattaaattactaaaaattaccggaaataattttggcatgtttgtggccaacattgactatttccaatcaacgctgacatcttccaaattatttactccaaaggtctttttctcaaacaaacaaataacattttattgaggtatgtttgacatgtaaaaagctgtacatagttgatgtatacaaccagatgtgtttgaaatgagcctacacctgtgaaaccttcaccaacaaggttatagacatatccatcacctcccagcgtatcctctggccctattattattattattattattatgtgttcgtgctaagaacatttagcataagatctactctctgaacgttttaagtacacaatatagttaactatatgtaccatgttatatagtagatcatcataacttatttatttttcataactgaaactttatctatttactgccacctctgtatttcatcccccaccaaccagtgcctagtaatcattcatcattctactctctgcttctgtgagtttatttttaattccacatataagtgaggtcacacagtacctgcccttttttgtctggcttatttcacttagcataatgtcttccaggttcatccatattgttgcaaatggaaggatttccctctattttaagaccaaataatatttaattttatgtatgtaccatatttttatatccattcatccattaatagacacttagattttttttccatatcttagctattgtgaataatgaatgctgcaataaaaacaggagtgtaggtaggtatctcttcaaaattctgatttcaagtccttgggataaatgcccttaagtggcattgatgggttatccatcttatctgcaatttttttggaagaatttgagagggattggggctagttcttctaaggtttgatagaagtcaccaatgaagccacatagtcttttacatttatttgctgagaggctttggactattgatgactacttacttgttcttagtctattcagattttcttttcgtgataattcattcatggtaggttgtaattctatttttaattgtatgaggaaactccatactattttccacaatggctgcagcaatgtaccttcctacaattactataccagcattcccttttctccacatccacacttgctatctttttaaaaaatatatataagccaaccaaataggtatgagatgacagttttctgtgtttctgatttgcacttccctaatgattcatgatgttgagcatcttttcatgtaactgttagccatttgtatggtgttcttttttttgagaaatgtgtattaagatcctttgcccagttttaaagttgagttatttgaggttttggcaactgagttgtagaagttctttatgtattttaaatattaaccccttaccagatacatggcttcaaaaattttctaacattctgtagattgtatttttattttgttgattgctttatttgctgtgcaggagctttttagtttgatgtaatctttatttttatttcaaagaaaatttgttcaagaaaatttgttgtgaggaattttggtgtcatatctaaaaaattattgccaagaccaatatcaaggtttttcattcattttcttctagaagttttatgatttcaggttttatatttaagactttaattcacttctagttgatttttatgcatggtgtaagatataggtccatcataagaggctactgtgaaaaattacacgccaacaagttggataacattgaagaaattgataaatccctagaaatatacaacctaccatgactgaattatgaagaacagtaaatctgaatagactagtaacaagtaagaggtcatcaataatcaaaagactcccagcaaataaacgtcaaagataatacagtttcactggtaaattctatcaaacatcagaagatttagctccaatccttctctaactcttccaaaaaaactgaagataagattccaaactcacttctcaaggccaatatcatcctgataacaaagtcaggcaaggacagtacaagaaaaaaaattacagccaatatccctactgaacatagatacaaaatccttgaacaaaataacaaaatcttagagctcatttaaaagatcacacaccataactaagtgtgattaatctctgggatgaaaggatctttcagcaaatgcaaaccagtaactgtgatatgtcaaattagtagaatgaaagatgaaaagaatatgatcatcttgatagatgtagaagaagcatttcacaaaattaaacattcttttattataaaaatgctcaacaaattatgtatataaggagtgtacctcaacataataaagcccaagctactgtcatattcaatggttagaaactgaaaacttttcctcaaagatcagaaacaaggtaaagatgcccactcttgtcacttctgttcagcatatgctggaattaacagccagagcaactagacaaaaaaaaatacatccaaattaaaaagaaagttgtctctgtttgcaaatgacatgatcttatatatagaacactctaaagactctactaaaaaactatcgtatttaataaatatattcggtaaatttgcaggacagaaaatcatatgtgaaaaatcagtcgtgtttttacaaactcacaataaattatctgaaaaaggtattaagaaaataacaccatttacaatagcatcagaaaaatacagtacttaggaataaatttagccaaggggtccaaagagctgtacactgaaactataaaacactgatgaaataaattggggaagacataaatcactggaaagatatcctgtgttcatgtattggaagacttaatatcattaaaatattcataccattcaaagcaatttacaaattcaatcaatgcctatcaaaattccaaagttatttttcacagaaatagaaaagcaatcctaaaattcatatggattcacaaaagtcctgcaatagccaaagcaattttaagaaagaggaatgaagctgaagacatcatacttcctggctttaaagtatattacaaagttatagtaatcaaaacagtatggtgctggcataaaagcagacacatatatcaatagaacagaatagagacccctgaaataaacccacacacatacagtcaactagtttttgaaaaggaggcctggaatacaaaattgggaaagggtagtctcttcaataaatggtgtcagaaaagttggatatctagatattctaaaggtctttataagatttttgaagacttcatgaattttcaaaattaaataaacaatatttgtgctttaagtacgtgataagttctaaacaaactataaatccacttatcaaaagacaattgctaaaaaaaaaaaaagaatttactaaaaggctaaatctcagaactcactgcatttttcaactttcaaaatctattttaattgttcatatttgtatcagtttggttttcttaacttttgaaagtttttgttatatttagttacctctttctacatacccacatatttttaattgttcaggttttttaaatgagagattctaagacaatttaaagttttaaaagcatgttttccattcagagaagtatattttgtaatcagtaatgaaattttaaaataaggagcaattttattttgtggaaaaaaattatcatgaaagcatggggccacacaaaacaaaaggaaaaaagtgaggatgcaaggaagagattttaaataaataatatgattatcataacaaatgtgacacgttaacacaagtacaatttctgaaggaaaaacagaagcaaatagttgaccattctaaaatactgctagtgtaagacatgcacttaggaacaagataaactataacacatattaaatcttaggtacaattaactagaagttatcaataaatggctttaaactatattatgaagctatcgtgatcaacacagtatggtacggttggtacgctctttaaaaactgaagaaaataattttgaaataataaaattgttgacaaaacagcaactatatattatttgaaaggaatcaagataaatacgtatattatatgaattgctgaaatgttgcttattaattatggagcatactactttgaatattcagtatatttatgagactaagctactctctacccctttatttaaaaccaatataatatttcttaacatgctactataaagacaaaataaaaccattctttaagcttcatagaagtctacaaatattgtaaaaaatcattccacataatatgttgtaaacttataaaaatagtttaatagttgtttttgctaatttaccaaattggttatctgacaaattattttctgagaattgcctttggcttattcgatcatcagtaacttggcctttatctatgttatgaatactcacagtttcccttctttgagatgtttccattcattaatgtaagggggtatgtgattatcaactttgtgtcaactttagtaggccacattacccagatatttggtcaaacaccagtctggatgttacatgaagttattgtttagatgagattaatatttaaatcagtagacgttgagggaagcagattaccttaaaggccttaagaaaaaacaggctgagatcccttatgaagaggaaattctgcctccagactgtctttgggatcaacattccatgccaactctccagtctgtgggcttatgctacagattttggacttgccatccttcataatcacattagctagttccttaaaacaaatctctctctctccctccatatatgtatataaacacacatgcacacacacacacacagacataaaatacacatatatattaataatatatgcatactgtgaaaggaaaataaatcttggggccccaaaatcattaaactaaagggaaaagtcaagctgggaactgcttagggcaaacctgcctcctactctacgcaaagtcacccctctgctcactgagataaatgcatatctgattgcctcctttggagaggctaattagaaactcaaatgtatataatcatttgtctcttacctacctatgacctggaagtcccctccccgctttgagttgtcccacctttctagaccgaaccaacattcgtgttacatatgttgatttatgtctcatgtctccctaaaatatataaaaccaaactgtgctctaaccactttgggcacatgttgtcaggacctcctgagactgtgtcacctgtgagcatcctcaaccttggcaaaataaactttctaaattaactgagaccagtctcaaattttgagggtacacaacacacacacacacacacacacacacacacacacacacacacacacacatatacatacttttgggtaaaaagtaaaaaatgaatccttttttaatactggttcttctagtctgacatgctgtattcccatgctagatcactaggagacaaatgttttcatcttccatgtaataacacaaatgtattgccctcccaaagcttcctctgattccctgttctgcgctaggctttcctgcacttatgcctgcaaatgagttttgattgtgcctgccgttgcttgttatattgactatctctatcatagactattacatccttgaaactatgtttatgtgtccagggcctgtagattaatggatggatgggtggatggatcagtagatcaataaaatcagctaccaaaacataaatctttcaaaatattggatgtgctctactacaagaccctctcaaaaaaaagaaaaaagaagtagttcatgagaagtttgagtccttaaagttaatgctgttttctctacattctaatcccagaagtacagcaattcacttgaatgatagaaatgcttctaacaatgaactgtactgaaaatgatttaaaatgaaagcttgttggacacaaaacgtatacaagttatatcactgaacttaactcccttaaacatattgctagaccaaaatctggagtcgggggaaggaggggtctgtggcacatcctcttacatttttagtgggaaaaagcaagacacattctagacttttattacacgggtccaaatatagaagcagttctatgacataaagagttattgtttcaataagtatcttgccagccaggcatggtggcttatacctgtaattccagcactttgggaggtcaaggcgggtggatcacctaaggtcaggagttggagaccagcctggccaacatgatgaaacctcatctctacaaaaaatataaacattacctgggcatcgtggtgcacacttgtagtcccagctactcgggagcctgaggcaggagtatcgcttgaacctggaggtggaggtttcaatgagccgagatcatcccactgcactccagcctgggcagcagagagagattctgtctcaaaaaaaaaaaaaaaaagaaagaaaaaaagtgtcttctctatttttaaccagacagatttatgatgggaaactatgatagtgtttgttttgctattgcttttttgtgagctcatgtttcaatgagtttgagcataaaaataggttacattgcagagcaatggagttagacaaatataattttctgttgatataactgaaggcaaggaatctcaaaatctcagtgcaggtggtctgctgtggcattgctatgaaggtccaggatcctagcaagagaagaatcattacagatctctccacaagaactatttggcattcacaagtagctttcctagtgaagacttactatacaacaaaatagagagagcagtaattccttctcagccaccagaatttttgaaatagcatcatcctatatctcaagagctattggtatcacaaaaaagaaaacatttcttgatattcagctaagagaaagcagttgctctgtgcaaagcatttctatattaacatttttgtattttacaacaacctaacgttgtactctttttagttactaaggatccatgcattatgcttatgtttgagcccctcagaataggttttatctcagtaaagaatacttgccattgtttttagttttctgccagttcaatgatttcttagcatttcattccatgcacatttttacagaaaacaaaaaaatatataattcaaatagatcaaaatgaatattctccattgaatgctttttactggtaaaattaaactaaatatagtcagccgggcacggggacttacgcctgtaacaccagcactttgggagtccaaggcaggcagatcacctgaggtcaagagtttgagaccagcctagccaacatggagaaagtccatctttactaaaagtataaaaattagctgggcgtagtggtgcacacctgtagtcccagctactcaggaggctgaggcatgagaatcacttgaacctgggaggtggagcttgtggtgagctgaaattgcaccactgtactccagcctgggtgatacagcaagactctgtctccagaaaaaaaaaaaaaaaagaagaagaaaaaattaaatgtagtcaatcctccctttctgtgggttctgtacccctgggttccacagctgtcaattaaatcaatctcagatccaaaatacaataaccccaggtttcacatggccagcttctggacttgagcatctgtagagtttggcatatgcagggtgtcctggaatcaatcccctacaatgactgtattacctcatttaatcataaggagaattttgaaaagtgtctaccattattttctactccactttgtggatgaaattgtccaagacattaatagagtaaaaaaattctaaggtgagaaatctaataagagaacaaaaatcctggcatctaaaaccaaagtatatctgatttcaaagtgctggctcttaactatcactctctatcttcccctaatcttcccagcaagtactgtattataatcaattcacctgtttttttttctttttttgcaaaatcacttttgtgtaaacactgacctaggcactgtgttgcatttaaagacaaaaaagttcatcaacacaagattgttctttaaatatacatttaatccactaagggatttaagtaatcttcaaagaccattagtcttcaccaattttccttttgaatattttaatagcttcaaaactttacaatgtgtaaccactttttggctctacattaacttgtgtgtaggaacaattcatctggtgagtgaatcctgatcatctctgcagcatacccatttcaacgaggagcttctagtgctgcgatagacgtgaagaaaaagtagatatttaaaaaaaattctcccacgtacaacttttaccaggaaatagaagtttgaaacaaagtgctaaatggtaaattgatcaagactatggatgagtcttacattattttatgtgcaaacaagaaaaaggaaaatttatagtttgctcaattcttacagctgggaaaggaaaaattgtaaactaaattgtgtttacacatttggtgattttaaagccttcatatgtacttttcctagatgtcaaatgtcattacataaaaagtgttttgttttgtttttagtattgcaatgtgctcaagaatcatacaaaatagaaaagacacttcagacccaagaaattgggaaaaaccgcagaaagaaaacacaattgagctgacctttaaggacagaagaatttcaacagaaataggagtttctgttttttgtctgttttgggaagtacagttccagatgaaactgtgttaataaaaacattattcttcagaggctgaaataatgaaaaatataagactaagcaaaaaaaatgaaaaccaaattagtctatatcataaagagcagtaaatttggaaaaaataaataagctctgtatgaaattattacacacattactatgaaaaaagagtttcccaaagtctctggataaataaaataatttcagtgaactagagaatgtcacccgagattaaaagcgccttcttattgcagaaaatctcttaaaatagacacacacacacacacacacacacgcacagagacagagagagagaagacagagagatcatgaaagaaaaggctattcaattactttagagattaatgaaattaaaaataaaatatttactatatacactttcccttgacttaaactgaaacaaaactaaatgtggcaactttgatttttatttgatcaccttatgtgctttacattggtagcataaatgaaataactatactaaaaggaaaattatttttcatgctagttaaatattcaattgattgttttggcaggctaaatgtggatggggctaggagtacgagggagatttttaatgagcaggtagctctgaactcaacagcaaattaagggagcataaatcctttataaaaactcttcccacatacttcctctcctcaccaccagttcacaaaaggctgctgtttttatgagagacactgagaataaagtctgaagctgtgaaggaactggttaagtcagaacaggaagggaagaggctatgaatgcagaagcaactcagaggcgctgaccccaaaggataattgccagagagggttcttcttctcaggtagtctttgtgatccaacatagtccctaaataattctaataaacaagtgtcattttttgaaaagttcttactgtagatacaacatgcagaagccccagtctccttgttggagtcaaatgtgcatatttagttaaaaagaaaaaagagaacacctgtttccatgactacagtgttaatttacttcttagagttgatcttgtgcgggatttctgtttttcttgctatagtattatatgcattgttgacatttagatttgcactaattttagtgcacatctacactaaaatatataaagtatgaataagtaaacaagtatctctttttttcaatttatgttcttgttcttttgaaattactaacacaagttgcaaaatcaagctcattttagtcaacattatgtattatctgtacatatatacaatattaaatagaatattattcaaaaggcacaattttgtatttagtaagaaaagcagaaaatcagttacctttgaataaataacttgtttgaaaaataagttgggaaatttacagcagcagtggcataaaatgtttaaggcttctcatatctctctataaaaagtcaaatcaaacaacaatcacaaaaatccatatataacatccacaataaaagtagatgtaaagttgcccacaaaacttgaatgctatgtgtttgggatctgggtaaaaattttccatcgggtcaaatatattgatacagttgcactatgcagacatcctggataaatgagttagctcatgaggccaggagttactctgcttgggtggctgattgaaatttggaactaaacataggtagtttatactgaacaaacttaagtgccaaatttcttcatttgttatagaaaaagttatccaaatgcttacagagattagaaagttggagtggatttattacatgatagctggtctcctgcccataactatgtctccattgtgagagtccagaagacattctctgcattgatgctttgaaaaacacattgtgagtggaacacaaaaatgaaaggactctgctacactgttaacatttatactatacatcttaccccagccttccccaaggaacccctagtcattttcccagatgactgtgcattaggggaagtagttaggatttggggattactcgttgtttggagcgcactattttctgaagacccaacactagcattattcacctgccaagattaatagagttgtgttttatgtccatctcacagtgagcactgtgtgtctgcatctacccatgatgattttccaaattttaggatgtatatttggaatagacatacaaagcaaccggcataagcccacactagtttccacactaatatagacccatgggctactttaatatactaggaaagacaaagtgaaagaaagaaaaattgcttctacctattaaaatactaaaggcaagacaatactgtgttttcctggcaggattgcagaggttagtgctaacatccagttaagtgattctaatcgtttcttctataaaatttgcctttttggctgaaacaaaacacagatgggtcttgggaaaagagaaagaattattataaattttatcaagtggagattctaattgcagtattgctttagatttagggttggtttagttactggagaaaatcaacatatcccttggtatttgaaaagcagccatcaatctgttaaatacttttccctatgaatcttagtaatgacagtatactttctcaccacaggattatatcactctccaactctcagtcatagtctaatctgcaaggactttgatcatctcttcatttcacagaacatcaaattagcccacgtcaatgacatcataataattacaggaagcggtaataatcctaagcactgcaatatgatacatgcatgccagagggtggggaaaaaaataacagacaatttcaaagatgtgcaaagatttctcaatgataattctaagatctgactgatctggggaatgctgacatcctttcaaggtaaaaaacaagtgtatctgttctctcctgtcataaagaagagacacaatgcctactgagcactgtggttttagaggcaatacatatcccaatttggggtgctacttccacctatttactcagtggttagaactgctgctagatttgtatgaaacctagacttcgaggaggccctgcatcaggttcaggctgctgttaaagctactctgccatttgagttctatgaaggcattatgatgaaatgttgtaaaagttaaatatactcttagtggatttttaaagacagctataattgaattacaacagtgacatttgtgattttggagtaaagatatgtaatccttcacagattactattttcttataagcagtttctagcatgcttctgggttcttttacagactaaatgcttgatatagggtaccatagtgggctgagctgtgtattctgaactgactatgtctgacccataatgacatgaagttggacacataccgcagtagtctatcattaattggaagtgacatatgtgaaactgggcttgagtaggttccgaaggcgcaagtaccttctattagctaatagctcagactttcatggtccctactcctgttatattacccactctgtcccaacccatatctgtagcatgggttgtatcccatgacaaattgacagaagacacattacaattggccgggcgcggtggctcaagcctgtaatcccagcactttgggaggccaaggcaggcggatcacaaggtcagaagattgagaccatcctggctaacacggtgaaaccccatctctactaaaaatacaaaaaattagccaggcgtggtggcgggcgcctgtagtcccagatactcgggacgctgaggcaggagaatggcgtgaacccaggaggcggagcttgcagtgagccaagactgcgccactgcactccagcctgggcaacagagcaaggctccgtctcaaaaaagaaaaaaaaaaaagaagacacattacagacctggtttacagacggccctgcgtggtatggctggcaccatctcaaagcagaaaggctacagcactctaacctcactcaggagtggtccaggcaagtactcgtgaaaatataattttgcataatgcaactgtttgttcatttttcattgaacaggagatgaccagaagaacattatgccctgatctttgagaactggctaataatttggttaaatgtttagagacttggaagaagcacgattgcaaaattgatgatttgggtgcctgcagaagaaatatagagacatacgaatacatctaaagagcaaccatagaagaggagggtcttattaacgaactgaacaagatgacctattttgcttctttccccagccaaccctgctcttgcccaatactcatggactatgcagccaaagcagcagggatggagcttacgcatgggcacaacaacatgcacttttctcatgatagctgatctaagtgtcggccaatagcagagttcaacactgagctccctatatggcatcattctgtatggggacactccagccactggttattatattgaatgcttccatcatggaatgggtagtaccccgaatatgaatttgctttccctgctcatagttctttcaccaaaagcttcatctatggatttacagaatgccttactcaaaagtaaggtacactacatagcattattctcactaggaaatttctcttttttcccctaaataaataaggtatggcaataggctcaggctaatggaattcaccgatttttttgtcatgtttcctattacactgaagcagcttgcctgatagattagtataatgcagttcaaagattctgtatctatgtccattgagtgatgatactttgaaatgggggttgggatcttattcttcaggatatattatatattctgaatcactgattctataccaagaaacttctgtttcttccattttaagatttccagatctgagaatcaaggaaagtcagtgggaatactattctcttctcactattagcgctaatgaactactagcatcatttcttcatcctgttctcaaaattttgggttctgccagcctaaatgttttctttcccaagagaatatttctttttataggaaacatctaaatggttacatttaattgaaagttcaggctgtcacctggccacatggtactccttaagcagcaaatcaataggcaattaagacagagtgttgactgatgtgatttgattctatcaaggggaacgtgggttcctactacacggaaggagtcagaagtgtgtctataatgttgggaagtctcctaaggctctcagtagtactttcatgacttgtgataaaaatcaatcaaagttataactactttaatttaacaggactgttaatggcacagagcctccaagaataaaggtttaagttacttcaccaggcaaataaccatggccaactgaggtgatagttgagagcaaaagaaataaaggatgagaaattgaagaaaaatgctataaatattaggtctccagctgttacaatcttaaaatcgaggttataaaaactatacatgacaaatgacttgcagatgaattgcaaggaaacagaatgaacataaaaagaatctatatcagtcaattcagttaatattcctccagagaattttttttaagcaataggggttcactctgtcacccaggctgaagagcagtggcataatcatagctcactgccaccttgaactcctgggctcaagcaatcctcctgcctcagccatcagagtagctgggactacaggcatgtgtcaccacattcagacaatggtttttaattttttgtagagatggggtctctctatgttgcccaggctagtcttgaacttctggcatcaagagatactcccacctgggccttccaaagtgctgggattataggagtgaatcaccacacccagccttaatttattacaaggaaattatttatgcaattgtggagggttggttaagcaagtccaaagtctatagggcaagccatcaggaagcaaagattaggaagagttggaaataccataggcatgggccaaaatcatctacaggcaaatttctctctctcattctttccttctggcctcaattatgattttaaggcattccaaatgattgccatgacaacccacattattcaagagaatcttactttctgaaagtcaactaacttggatcataattcaaacaaatacaatgaaaaaagaaattgaccaggaattgtaaaattaatgacattaacaatgtattgctatttcatcatgttaaatgtttagagtgcttatattgtctcatatttactttaaaatagtataagagagaagaaaataggtaggggaatagatgaaataaaaatgactacaacttcatgattgttgaaactggatgacaggaacatgggaattcattgtactaaacagtagcccccacttatttacagggaatacattccaagatgtatagtacaaaaccctcctcatattgttttttttttcccatgcatacaaacctaggataaagtttgatttataaattaggcacaataagagtttaacaacaataactagtaataaaatagaactgttataaaaatatactatcataaaagctattttaaacttatgaattgtttatttctggaattttccatctaatatatttggaccacagttgactgtggtccacaaaatgagaaactgaggataaggaggggtggttaccatattggcttctatatgtttaaaattgatgaatatttttaaaaatgagtcgggaacatgtcataactgagtcagaacactggtgctattggacagctttatagccaagagcccaaatatgcagcatgcatctgccacccatgagctgctgccagctccgcccccgcagccaaactcctccaggtgctccccaggacttctgcttattcttactcaatctttttgagctggtggtaaacaatttctttcagaggagttactcataccagagttttggaaacctccttaactattccacagatcacatcttcccatgaacacaaacatttggaaaaaaaagatggccggatctgactggggaaataacaatgcatagactgatctaattttcctccaaaaaccaggaccatgctgattagtctggctcaccctctgtggctccttcttttctcattactcataatgatcctttttgtttttacctcacaaactgtattttctttcctaccgtatgactttctttaggacctcacctattcaagtgtgaacactaattgtggatcaggttaaagttccttgaagctccctaagcaattccaagttagaatatgtattcgggcctctgtctttgcattttgaactttgcatagcagctattttttcagaatgtactctaacagatatgaagctcaactgcccatggcaatacactattctctaggagggctgttgattaaatccttaagttggctcagaccagcaaatataccgagtcaaatctgcaagggccagaacattcctggtgaaccttgtaaatatgaggccataaatttgaggttagaggagggtgatgtcagcaagattgaggaataggaagtcacagaattcactctcccctacagaaagatcaactagcaacgatttacagacaaaaccaccttggtaaaaataccaaaatgtgggagtaatcctgagtcacttgcattatctacagaactgaataaaaatctgcattggaaggtaggagaaatggtctttcattgactgcataacccttattcctcctcaagttgtgacagtaccacacagagaagatttctcagggtccacagtttttaaattgggaaataagaagtgggaggtgaacattcagcttccttagcatgctgagatgcatcccaggaagtcgactttgttctcacatcacagggaatgggaaatgtaggaggaagttacatggttagactatgtggggtcaggtagaaaaaggcaaggagaaagagcccacagagatcaacattgcagattttattaaaagctcagtatatactttccagcagtagcactcaacgagaggtaccagctagtagcataacttacttgccaagccgagctgatcacttccagaagaggtgggaagtggtacctgtcttgaatccctaaacagcctccaggaccagccacagacactatctcggtcggggtcccaccctgtgaaggagaagacctttgcagcaaatttccgtaattagcaggcactaaatatcccacatcagaagctaaatctgtgtttcctgcagtctcaagccccacctccagacctttccaagggagagagaaaaccaccacggcaaatgttgaccacaagcagacaatagttttgccacatcagaaagtataatcagcccttctctaagactcaaagctcaccccagaccacatcaaggaggaaggcaaattttaagcatgcatttctactgagcacggtagttggtccatccatctcaatccacttaaacttgggtcccctcccacaaacctatacaactcctgaactaaaatagcagtatctctgtccaggaaatacatcatgtggccgagccaaatcagaggtgattatagtgcccataattacaaagcagagcgcaggcagtggtcttgccagatggcagagcctactcagaggccccaacaaatttcagagcaaagggacatcccaatcatctagagaagctaaaagcaagctctgcctgcccaggatcaataccagctagcctatccaaaacatagactagactaatgatattaatgccaaagaactcctataaaaactggaaaaggtggctatacctgcaaatgcacaaataccaatggaacaactaagaataccatgacacctccaaaagaaactaacaaagccccatcaataaaccctaaagaaagggggatttatgaaatggcaaaaaaggatacagaataatcctcttgaaaaattcagtgaacttcaaaactatgcagatgaaaaaattaaataaaatttggaaaacaatacataagaaacttgacaaaaagagaaacaaaacaattaaaaaatagaaattctcaagataaaaatacaatgactgaactgaaaaatgcaatagaaagcttcaaaagctagttgatcaaggtgaagaatcggtgaactcaaagacagaacatttgaaatactcaattagaggagcaaaaagataaaagaatggaaaatgaatgaagaaagcctgtgggaaccatgggataccatcaagcgacctcacatatgcataataggtattcccaaaggagaatgaagagaaaaacattatcagaaagcatattttaaaaacaatagatgaaaacttccctaatctgaggaaaaaagccaacatcaaggtacaggaaatgcagaggtcatcaattaaattcaacccataaaggagtttatgaagacatataataaactatcaaaaattaaagacaaagaaaaaattctgagagcagcaagagataagaaattaaaacatagaaaggagtcataataggattaacaatagacttcttagcagagccctgcaggccaggagagggtgaaatgatatacgcatagtgctgaaggaaaacactttaacatgagaataactcagcaaagctgtctttcagcaattagggagaaattactttcccagacaaaaacagcaaatggagttcatcaccactaggcctgtcttataaaaattgctagggggagcttcttaacctgaaactaaaggctgctaattcataacatgaaacttattaaagcacaaaatctaatggtgtaagtaacagacagcaatattcagaatacactagggctgtaatattggtgtgtaacataattttttcccaggcatgggggctaaaggacaaaattattagtaaaatctttggctaaattaagttttcaagggatatatattacaaaatgatgtaagtttgatgtctagaacataaaatgggggatagtaaaagtgtaaagttgtgtatataatcaaaactaagctgttatcagcttgaaatagactgttataaatgtaagatgttctatgtaagcttcatggtaacaaaaatctatacagcatgcataaaacaaaaatttaaacaattccaaacatgccattagagaaaacctttaaaccaccaaggaagacagcaagagaggaagaacgaaacagtatctacaaaagaatcagaaaacaatgaccaaaatagcagtagtgagtcctcacctgtcaataattaccttgaatgtaaatggattaaattctccagtcaaaaaacacagagcaaattaatgcacaaaaacaaaacccacctatatgctacctataagagactcacttcactttaaaggacacacctagactgaaggtgaagaaatggagaaaaatatgccatgcaaatggaaaccaaaagagagtaggggtagcggtacatgtatcagaaaaaatagattttaagtcagaacttgtaaaaagagacaaagatggatattatataatgaaaaaggagtcaattcatcaagaggatatattgattataaatatataggcacccaatagtggagcacctaaatatataaagcaaacagtaaaggatctgaaaaaggagatcaattgcagtatgataattgtagggggcttcaatacatcactttcaatattgaatagataatccagacagaaaactaataaggaaacattgaacttcaacaacactttagatcaaatggacatatacagaaatatacagaatattccattcaacaacaacagaatacacattattctcaagcacacatgaaacactctccagggtagattatatattaggtgacaaaaaaagtcttagcaaattgaagaagaatgaaatacactcaggaataaaattaaccgaaaaggtgaaagatctatacatttaaaactattaagcattaataaaaaaattgagaagacacaaaggaatgaaaagatatcttgtgttcgtgggttgtacaaattaatgtaattaatgtggttttttgttgttgtttttctttttctttttcgtttttaagacaaagtcttgcttttttggtctgtcacctgggctgcagtgcagtgacataatcatagctcactgtaacctcaaattcctgggctcaagtgattctcctgcctcagctttctgagtatgtaggacaatagctgtgtgccactagacccagctaatttatttttaatttggtagaaatggtatcttgctatgttgctcaggttggtcttgaactcctggcctcaagcaatcctgccaccttggcctcccaaagtgctggaattattggtgtgagccactgtgcctggcccaattaatattgttaaatgtccttgtaacctaaagtgatctacagatttgacaaaattgctatcaaaatcccaatgttgttttttatagatatagaaaaaacaatcttataattcatattttcatattttaaaatctgaatacaaaattaatattttgtatttagaactacaagaaacatcaaacagccaagataatcataggtagaatgaacaaagctacagtcatcacactacccgatttcaaactatactacaaagtgatggtaattaatacagcaaggtacatgtatacaaatagagctatcaatcaatggaacagaatagagcacagaaatagattcacgtaactatggtcaattgatttttagcaaaggtgccacaaatttataatggtaaaaaggcagtctcttcaataaatggtgttggaaaaactggatatctatatacaaaagaatgaaatcgaacccttatctcacaccatagacaaaaatcaactcaaaatggattaaagacttaaacataaagcctaaactataaaactattagaagaaaatataggagaatatatatacaacattggctattacaataatttttaagatttgacaccaggagtacaagcagcaaaagcaaaaatagacaaaatacattaaaataaaaagcttctgtacaacaatgaaacaacagagtgaaaagacatcatgtagatttggaaaaaatatttgtaagccatacatctgatacagaattgatgtccaaaatatacaaagaactcaaaacaaatctatcacaagaaaacaaataatttgattaagaaatgggcgagggacctgaataaacatttctcagaagaagacatataaaatggctaacagatacatgaaaaaatactcgatatcactaatcactagagagattcaaataaaaccacaatgagatcaattcccatctgttagaactgcattatcaaaaagacaaaagataaaagctggtgaagatatggagtaaagagaacccttgtactctgttggtgggaatgtaaattattatagccattatggaaaattctataaaggttactcaaattctaaaaatagcattaccacatgatttagccattatgtttctatttacctgaaatatttgaaatcagtacctggaggagatgtgtacaagctcatatttattgtagcactgttcacaataaccaagttatggaattgaccctaagtgttcattaacatgaaaggataaagcaagtgtaatatatatacacaatgaaatactatttcaccttaaaaaaataaaggagatcctgtcattggcaaaaatatggataaactcagagggcactgtgttaattaataaaagccaggcttagaaagacaaccaccacatgacctcacttagctgtggaatccaaaacaagggatctcatcgaggcagaaatagtagaatggtggttacagaggctagaagtttggggtaatggggagacaataatcaaagtacaaagcattggttaaatagaataaatgtttggggtttttttttttaaagatctttagcatggtatggtggatatagctaataactgagtactgtacatttcagtatcactatgaaagtaaatttcaaatgttctcaacataaaaaaattaaatatttgaggtgatgaataggttaattagcttgatctaattattccacattgtattaaagattatgatctcacattgtattgtacaaatatatacaactataatagtccaatatataataaaacatttttaaaaagaattttgaggttagaaactgcatgtaaaatttccccaacgcctcaaaatgatcgactctaataatcatcccttctaatccagcagcccatacttttgcaattaccaatctttctgacccaagcctgacccctctaataccctacattataaaagtaacccctcgacaggaggttcatcttcattcaacaatgaggcaataatcaagaaaaaacttgaagaccaaaaggccaacaggagttcacaaaattcaattaagtctgttagttttgagaacagatcaaagaggtttaaaagtattccataaaattcagctcataaagaactgttttcattttatccttccttccctgtgtttcccaaaatatatacctctattataataatgtcttactctttggtattcaccaatctcaagccaatgatactatatttttctgaccaatttttaaatattcccatatgcttagctcttttgccattgttaacattcattttcatttctggatcaacctatctatgttttccttcctttgttccaaccttattgaacatttcttattaaacaccaggcactgggtatatcataatgaaaatacagaccttgtcaccacccctaatatttgccatctaaggaaaacacagataagtagcaggcaattgtaataattgctgtgattgtggacatagtaacatacagaatgactacatcagaatcatgtacgtcatgcctaacctgaatttaacacatcagcaaacccttgtgtaagggagtaatgcttaagctctgtatgtcatgggatgcaactgtgatttgcccctctcacaagcagtttaaattggtgggatgggagtcagagtgggatgtgaagctactgttgtaggggtgggaaacatgaatcccttttgtccttgacaattccaacacagtttgctacagagaacattttttttttcctccttacatggtcaattttctgtgtcagcctgactgagtcacagagtgcccaaacatttggacaaacattattctgagtgtgtctgtgagaaaatcttgagtaatacaaatggatctgatgaaatgggatgtaactatgtgtgctttccagcatcgaaggcagtttgtaacttctgaagaatgtagagcattttaatgctatttccatccccacccacagcccactgattagtatttcttttttgtttttagaaataattattcctagagcaagatctacctgctgtgttatttgctcagatttgtctttgaggcaaaaagaattctggaccctaaacgagtcctcttatgtgggtcatttttttaatactatgtgtctgtcatatttatttttcaacagcatacaagaagctaaaatattataacttttgttttcggttgctagggttataaggatagcagtagcaagttcagaaataccatctaccattatgcaaaagtgacaactatatctattcactgactttgacaaaacaataaaataaaagaacattacttgaaggaatgcagaaaattagcttttgctatttgcaatctccatatcacaattcttagtggttaaaaagattctggcaaacaaatagaaagcttgtatctacattaccctccttgacacaataaatacttgatcacatttatccttatggtggagatttttttcaaaaagacattacatatgaatgataaactgtcattttaaccatgtttcagcccacagatattaaatctaagtagcttttgatatttctacatcctaaaacacacccttcttctatgctttttgccgcctctactaaatggaaaacatctagtactaaatcagtgcacattggtagagatgagaaacatgcactgttggtgggagtgtaaatcagttcagccattgtggaagacagtgtcatgattcctcaaagacctaaaggcagcaatactattcgacccggcaatcccgttaccaggtatacacccaaaggaatataaatcattctgttataaagaggcatgcacacatatgttcattgcagcactattcacaatagcagagacatggaatcaacctaaatgcccatcaatgatagactggataaagaaaatgtggtacacatacaccacagaatattatgcagccatataaaagaagaggatcatgtcctttgcaggaacatagatggagctggaagccattattcttagctaactaacacaggaacagaaaaccaaataccatatgatttcacttttaagtgggagctaaacgatgagaacacatggacacatagaggggaacaacacacaccggggccctttggagggtgaaaggtgaaaggatctagactatggatactaggcttaatacctggatgatgaaataatctgtacaacaaaccctcatgacacaagtttacctatgtaacaaacctgcacttggacccatgaacttaaaatagaagttaacctccccccaaaaaaagacattaggaagatgcatatgttaattctaatttaattctttatggttgcataattaatttatcaatgattcctgaatttacctgggcctttagtatgaaaaataaagattcagctagagaaaggaaagacatatgccagactcattaatttttttaaaatatatatttacttgtaagtataaattctgttgaattttagttttagatatttactgaaattcagtaaatatcatattgaattgaggtggcagtgcaaaaatagttacaaaaatagttatttttctcttcctttccaactgctctctatgactttgtattccaaaattcactttttactactgacatgcaaaggcaactaacattgccaaggtatatcaattctcactatgttcaaaatcttggagaactgaaaaacaaagatggctttttaattggtaaaaatcaaacatgtattactttgatggtacttttagagttagtctctggaaccaatacatcaaattcaaaaaccattctcacctagaaaaagaataaatgcaaataaatgacatgaatgaaattcatgaaataaaagtgcaaatggactttgagcttcagcagtcagatgtttgtttataggatgatgttcaatgactcagaaaagcctggctagccgtgaattccctgcactgcactcagctctcctcagctgctccccttctggaagcagctccatcaggtaaaattatgtgcccgtaggagacatgaaaaaaagaattatgtaaagtggcaaggcaaggtcttgcccacaggagtgacaaatcagagaaattgcactcgttctagcatcttgggagaccctacgaccccacgtaccttttccctagcactaactcagagacatttcctttgcaatacagaggtagcttagttttctttaaagactcactctttccacgcatatagcacctgatgacaatctccaactcttatccagtcaagagtatgaaattcgccttcctcactttcacaactatccattggcaaaactgtactcattttaagcttttttttttttttttttggtcatcaggattttctcatttcagcctgtctttgatactgatttgccaaatatccacttgtctaatattttgaatgattagagagtatttaagttgtttgagattctataggctctggggtcatgatggttgcaaataacttagattgagttatttgtcttggagttgggcagtatttggtactgagtaacacaaagccactcgtgtctcatattaattcttgatatgtgtttcttattttgaaaaaaatcttgatgttgcccataccataaggccttatttccaccaatttgagcttcaactggagccgtttctaaagaggcagccagttttggtgagtagcattattcctgtataaataacagatgcagagaaaagagcagggtatgtggtagttaatacagtcatcactcacatacttggaatccttgaggggggaaaacaaacatgtaacacacacacagaaatggatgctaatgtaccatcttgcaaatgatctgtactcccaaaaaaggagaaaaagaaaactcttttaaaacaaacatggcgtaaggatcagatctaacctattcttctatgcaaatatgaaatggaagttcttgcaaagacaaatatggaagttctcgcaaagaaattttctgacacatacctacatcatggcaaagatggagaaaaacttaaggaaattaattttgtaagaagcaaaaattaacttgcatcctgcagtaagatgaatcctatccttaataatttgtaacaattacccatgttcttcagtgtctacaatatgaattccaaatctctgattaggctgtaaagaattatccaaataaatagtagtacttcaacattcagtcaccaaaatgcttactggagtgtctcaaagcaatctgcacattagtgaaaaggaaaacctaacttgaccttagaaacacttgaaagtattctcttacagaatactgatgtgaacatatgggtcacatataactgatcaggagtcttttaagtaacactgtccttgagctattgtatacaatggaaatgtttatcgaggttaaattaacaattagcacagcattcatgtttctaataggaacaacctgtttttagattggacttcaatcactgttaccattatgtggtactgtgtttctgacccacagaaacacttactgtgtttctgacagtccagacaagtccatgggcacagaggacaatgcagaagagaaaaagtaaaatcgaatcacaggcagcaatgtacagagtgcatttgaaagtgtaaatccctgaagaggaattcattacttagctttgagtttccaactatatcaatttcctagtggaacattagtatagaatctagcctttgttgagagaaaaaaggggttttctaagtttcaaagagtgtttcttttgtataacaagaacaaagcttagagacaaagtagaccataccaaggttatcacataaaagagacccccgactaaccactgacaggaatcagggaaggcttctagctttggccaggtgggcagcagagcaacgcagagacaacgcatcctctaagggggcccagagtggggtaaaaaggcagcgggaggagcaaaaccacagggaaagttcaacaaaagcataagggccttgtttcctgtttcaacttgatgctccaggagtttcccagccattagatcagcaggaatagttgtgccagtgcaaaatgtcagttttagaaaagttaagaaaattaaaatttgcacatatgaggtgaattcagaacttgcctctaatattgctgatttctggtagcttacctcccattgatttgctagacatataacttctgttttttcctctcttgatctaaccttctctatattagctgctttgggttagggcctttatgtgcaacaatgtatttttggtatgactttgcccagcaatgaaggtcatattagtttcccagtgctgccttaactaagtaccacaacctgggtggcttaaaacaacagaaatgcgtgatctcagagttcttgaggccagacatctgaaaccaaaggttggtgggaccacgctcgctctcaaacctgtagggaagatccttccttgcttcctcctggcttcttgcagtttgccagcaatccttcgtgttccttggtttgcagctgcaacatttcaatctctgactctgtcattacatggtgcctttccctcttgtctccagttttttcattctaagaccactagtcatcctggatgagggcctaccctcataatctcatctcatttcaattacaccagccaagacccaatttccaagtaaagtcacactcagtcaccagggattcaagcttcaacatatctttttgggggtcacaattcaacacataatagaggtaaaaagaaaaaacaaacaacaaaaagaaactcctcacatatttcctctaagggaatagctaaagtccccagttctatttgtaatcaaagaaaaactggtatatagcattgtacaggccacacaagctccctgaaaagagctggtaatttctccagaaatacccagtttgcctatagtttggaacagctgtagtgaaccatcacagccaaaccctcattctttctcttttttcttttcttttcatttttttttttttttttttttttgagacacagtctcgctcgctctgtttgcccaggctggagtgcaatggcgcactcactgcaacctccgcctcccaggttcaagcaattctcctgcctcagcctcccgagtagctgggattacaggcatagaccaccacaccctgcgaatttttgtatttttatcagagaggaggtttcaccatgttggccacactggtcttgaactcctgacctcaagtaacctgcccacctcagcctcccaaagtgttcggattataggcgtgagccactgcgcccggcctcattctttttcaatgtatagttcccatgatattcactgtagataaatcttttgtattatctagcttaagattcaccaaaaaaaaaaaaaaaaaaaaaaagggacttataacctggtggcagtgacaagtagtctcaaccttgccggaattcaggaagtcactaaagcacagctgtggcagccaacctccaaggcagcccttgtgatccacctcctgaaagagccttaggtagccccctccacattgtatcaggttggtctatgtgaccaagaacacacagcaaaaatgatggcatgtcactttcatgtttagctgatacaagattgacttccatcatgggtgtcttctctctccactcagctctcactctgggagaagcaagctaccacgttgtgaaaagccctatggagaggcccacatgatgaggaactgaagctttcagccaccagccagggaggaatggagccctgtcagcaaccataggaatgaacttggaagcagattcaccagcaacagcctagctctggtcaacagctctaacagcctcatgagagacctggtagcagaaccatgcagatatgctgctttttgattcctcagaaactgtgagagaaaataaatgtttgttttttaaaactgcaaatgtggagattatttgttacacagcagcacagtgctgctatcttgagctgaagttgttccagtcacatttctttccctctgctttccagcctcttttttcacctgaaggatgataggatttctctctactcctaaggaaaaagcttctgaataatctcatttttattatttcagtcctaaaataggctggatttatcaattaagagaattatctagctataaatacaacttttgatgacaaacatgaactaaatagtttagtagtgaaccttatttcatggagaaataaagtagttctattttttgttttttagaaaatttccaaaaaatttatttttccaaatctgtcttcccacttaattggcacctgaattcaagtgacccattctgcagtggtatccaataaacttgtgccccctaaactatctatttcccatgccaactcttagccttgctggcacatgcagaatccaccttcaattcctctagggtaccaagaacatgttggggagtggtgatcctgaccctccttcaatcagtctttagccttagtctttagtccttactccttttcttctctgatagtatccaagcagttaagtaaaccagtacctcacagacatctgcctgggaaacaaaattctagtgtccatttactgcggtatggcaaattttacagagcatttctctttaggaccttagcatcactcatcactctattctcccctttgcaggtaagggaagccatactttacaaatgctctacatggccaaactgtgatttccatctccctctcaagtctccccttaacctagagggacatagtgggattggtagtgtcagtttagctaaacagcatctctcgccaagctttgcaattatcgttgagttcgctgagcctaaaatacacaattcttggtgtctttttataactgaggaccctagtaatcagttcttgtattctgcatacaccaccatccatttacatggtaaaaatcccaaatcaaattcaggaccaaatgcaaggccctcttgttgcaatctgatggtttatttctaccaaccagccatctctcactgacttttcaacacaattagaaaaagtcctcccaaacacatagttttgaaattctacattgaatgacacagttctgcaaatctcccttccataagctgcctaccctgaatgctctttcaggaagcttattcagatgatcactctgatactctcacacagtataatctttactgtctagctgaaaagcctgttcttgaatattacagccctagcaattaggagctcagatatgaataacttctgtcttccccacatctctccctcacagattacacccactcccagcaccatcacatccctctaatagtttgaaaacaagatgagagcgacctagcctaggtaggcttagctgtgcacacgtccatgccacccaatctcagatttgttctgaatattctattaggagtccaaacccagaaaaaaacagtgatattatattatgaaacatatttaaataatccagagaatggttcaatcatccttcatttttcccctcaggcttccaacgtgcatacacagttcacctggagtgaacagataagggttcatcctcaaaatacattcctctgctttttctctatcatgctttacttcactctcatctttccaaaacagctctacttcctctcactctttgtcaccggataaagccatggatcagtcacaattggtttttctttttttttgttttttgttttgttttgagatggagtctcgctctgtcgcccaggctggagtgcaatggagcgatcttggctcactgcaacctccacctcccaggttcaagcaattctcctgcttcagcctcccgagaagctgggattacaggcgcccgtcttcacgcctggctaatttttttatttttagtagagacggggtttcaccatgttgaccaggctggtttggaactcctggtgacacgtgatccacccacctcggcctcccaaagtgttgttgagaggtgacaacttgctagcagccctcgctcgctctctctcggcacctcctcggcctccgcgtctgctctggccgcgctccaggagcccttcagcccgccgctgcgctgtgggggcccctctctggggctggcggagtgctcgtggggaggtgtggagtgggaagcgcgggcgggagccagggctgcgcggggagtgccggtgcgggttccgggtgggcgcgggttccgggtgggcgtgggttccgggtgggcgcgggctccaggtgggcgcgggcccggcaggcccgtactccgcggggacggccagcgcctgctgggcttgatcgggggacgcgctccctgtcggagtgccctggttaggtgccgcaaagtcctgcggcggcgagtgccattgagaggtgaagccggctgggcttctgggtccggtggggacttaagggaacttttctgtctagctaaaggtttgtaaacgcaccaatcagcgctctgtgtctagctaattgggtagggggcttggagaacttttgtgtctagctaaaggattgtaataaacgtaccaatcagcactctgtgtctagctaaaggtttgtaaacgcaccaatcagcgctctgtcaaaacggaccaatcagcaccctgcaaaacggaccaatcagcactccgtaaaatggaccaaacagcagcatgtgggtgggtgaggccaaataagggaataaaagcagcccaccctagccggcagcagcaacccactcaggttcccatgcgcaccgtggaagctttgttctttcactctttgcagtaaatcttgctgctgcttactctttgggtctgtgctgcatgtatgagctgtaacactcgccacgaaggtttgcagcttcactcctgaagccaatgagaccacaaaaccactgggaaggacgaacaactcccgacgggaggaacgaacaactctggatgcgaggaacaaacaagtctggacgcgccacctttatgaactgtaacactcaccgcgaaggtctgcagcttcactcctgaggccaagagaccatgaacccaccagaaggaagcaactccagacacacctgaaaatctgaaggaacaaactccagacacaccatctttaagaactgtaacattcaccgtgagggtccgtggcttcattcttgcagtcagcgagaccaagaacccaccaattccagacacattgggattacaggcgtgagccaccacgtccggcctcacagttgtttttccacagagaaaatacagaaagaaaaagagccctcgggttccaaacatcgttgcaaaccaaggattttcagaggttgttagaaaatggttctacctggtcaggcctaggcctcagatggagaaaactgcaatacaggcaatacttttcttgctaaaataccaactcttgtagctgaacttcagtttattattatgtaaaaagtacctgcttctttcctctaccttccacctccctaacttctgttcccattgtctttatggaccaagaccctagtggagtgggtgggtgaatgttccaccccaggaaaggtgtgagatggtaaaaacaattctatatactgagaaactcgacatcttcatgaactattaggaaaagatgttttccaatgcctgtttaaattatagctctggtataatacctttatggtattttattctaatggtaatacgtgaaaagaaaatgtgacttttaaactgttcttttaaaaatgaatatatatatatatatatatagttgtgatgcatgcaaaagaaattgaacaaatatcattgtcttatattggattgacaagtttatatttcagtattcatttaagttttctggcaatagcaactgttatctacttgaaaaccttatcatactcaaaggcaagatgtagagaaatataatgataatgaaaatatttactaatgaatgctgtattcaactacattaaaaaattaattaaatagtacttgtttaagtggcaagaatggccccttcggtatagagaaatgagaaaaaaagaaaaggagacactgaaaaaaatctggaagtgaaacagtgacagctgtctcagggtaaagaaaatatagcttgctccccaatagctatcagttatttgaagacatgccagcaaggtctccaaagctgcacttttcctgtgctatcccagttgggtgcacttgcctgaggatacaaaaggaagaaaagttagaatacctcatccgtcccagataaatgctattgcctaaggagatataagggaagaagggaagatgggagaaaagaacaagtgcttttacaaaggaatgagtgttgttaataacaaatggagctcaaaagacaatgaaacagtatctgtaaagtattaagatccctcctactttctcattctctgcaaattcgttacattttgctccatgttgcatatcacttttcctcttctagttcatgggaactcatcttcaaatcttagcttaagcatttctcataaattcgtcctgattttgtcgtattagcttctttctgtcctgtgttcacgtaacatacattcatgccccaattataactctaagctctatgtacagtgtttcttttaaatgcatttctttcaacaagtttgtgagttctttgatggcaggtactttaacttattcctttttctgtatgctttcctggtacattgcctggcagtagtagatgctcatcaaattgatttagtcattcaactgtagtgcaagatgctacatatttagaaatggacaaaatatgtgtccatatcatcagtttagaatttcatggagatgcagatattaagtaaaacaaaattaaggataatataaattgtggcaattgaaataaatggtgacacaaaagaaatgaacagagaaaggaagaaaggaaaatgactcagtaaacccaatgtagacatggaatcaaggagaatttcacagagaaagtaaagtttcaactgtcaccttgaaatcaatgtttttaattactgaagataatttgttttgtcatagtacataagtttatgtactcacattgatttttaaaagaaattcaagtattgtgaagagaaacatcttacctaggttttaaaaaagtgttttctttagattccattattccataatcaatgctaacaaaaacaatattgttttgttacttgaaaaagtcaatgcaataacagtggtgccttttatactgattaaaataatgagtaaaatgagttttatttttgaaaaaatcttctcttttcaatagttaaaattggatgcataaaagccaaagttgtagctaaatgaaaaattgtgatgatgaattgagcacagtaatttaatttctttgtatattagtgacataaatgttaacagtacacgagacaagaagagaggtagtaaaagaaacaattatttaaggaattagtgattaatattacagcagtgtttagagaaaattaacttgaacatcttactcttcataggtactaaataaaagaatgtcacacaaacaatagctaaaattatttagttgctagaacaaatctgaattttttgctatgtttacaaatagataacattaagagcagagttggtaagaaattaatcataagcaggaaagaatgtggaaatgatctaattcgtcacttctatttccagaattattgaagattagatcacctaaacatattgaataagaaatccctgaaatcacctaaacatattaaataagatacttgctcttcttatatgaatcaaaaaaacagcaggaaattaagaaatacttaaagcaggcatgcaacgaaagtggagctacacttaataatgcaacaaagagtattttaaatgccccaaacatttttatgagaatcacatgaaataaaattttatcagaattcctatgtttttaggacacaaagtcaacacagtaataaaacaagatatttctgtgtatgaatagtcatgttttattcatgccaaggttttgaattgtatcttagcaaatctgtcacatttggtcctgacaatgacagtgctccgtgaaatggccttaggaaacaagtgttcaaatgatagaaagcacacatgttcatcaacaatgcaatgtatttagaataagcataatctcatttcacaattatatagctcagtagaaaagcagtaatttttaaatgcataatttgtgtaaaaatagggcacatctggaggtcagcagcagcttcatttggtgaatgtattaacttcatgcacactgtgatctttcattatgcctcactacaataagccatcattcttttcaactgtcttaataaaaggcagtttgtttccttcaaaatcacgctcccaataatgtctataaaaaaatcacatagaacatacacttaacacaattaatgcatctcaaattgatgtgttttaaatttagttatgaaaatatagtattatgagagcctaaccagcctattccaagacgaaagtttgcataatgtcattttgttttaaactcttctcataaagagacttattacttaaaccagataagttctatggccaaattattttgagatccctcaaatatcataaagagtccagaaagcacggaagtttatgtttacttggaatacttgtaaattaaatgaaaatctgccatataaacatgtcagatagacaagaaagaatttcagtgttattttaaaataagaaaaaatgtaattacaattattacattttttaagagatttacttattaaaagttacaaaaaatggtgtttccaaactaaagaaccttcaggatagttatccaaccagttggtaattttgattcatttttcgtcaaaataaaatttgtgacgtttacctcaatgatattacacagatttagtcaaaataatcagtactgtgtaccaaatgaaaaggcaaatgaaataaattatccgaacatacccgtggtgcactgaagctatctggcaccaactcagaagaccacatgatctgtatttcttctcagctctaagttggtaacttaaaacccaaattggcaaatgctgcaaatcgcgttttttctcccctcaacagaaagccaatgggagatgatgaaataagaaactacaaaatgtataggggaaaatatatttacagggatgacagagagtttattaataaacatttttctggagtatatgatacttgagatatttgccttttaaaatttataatttgtttttatcttatttgaataaaatactattgttcctaagtttgtgttcatgctattattattatttttaaggtcaaatactatatagacctcagccttctcaaaactgatatttacccttgcaaggactttggaatcttttcatggtaattacatcttttgtactcatgtgcttctgctgtcacgtattttgtgtatcttaattttttatatttttaagtaaatcacatggaacatgaaaggggatctagcaaatggagatacatttcatttatgcattggatatctttgaactggaaaatgttcaattcttccaaaattatttcaatgaaattccaataaagcagattcagtgcaattccaactgaaaacattaatataattccaataacaattcaactattattatatttgaagcttggtgagttgatccaaaaaggtaaatgtataaaagtcaaaaatggccaacacatacttacaactgaagaatacattaggtgagatttccctctagtcaatatcatgacttaatatgaatattaagaaagacagttttgctggcataaatagtacatagattcaccaaattaaataagaagggcaggccaggtgcagtagctcacgcctgtaatcccagcattttggggggccaaggtgggccgattacttgaggtcaggagtttgagaccagcctggccaacatggtgaaaccctgtctccactaaaaatacaaaaattagccagtgtggtggcacacgcctgtaatcccagctacttgggaggctgaggcaggataatcacttgaacccaggaggctgaggttgcagtgagctgagatcgtgccactgcactgggtacagggtatatgtcagaattggcatattgggtaagtaaagaaagaataatcattttcaataactgttgctagggcattacattatccatgtaagggaaagtatccctaatatcaccatactcaaaaatcaagcccaattatatccctaatctcgccatacacaaaaataaattccaggtactttaatgaaggagaaaaatcaatataattttagaagaaaattaggaaagttttttatgacatcaaggcagagaagggtaacaaatataacagagtacatactatgtagcagaaactacaaatctaaatattaatacatgctaatgcactaaaatgctgtttatgaagagacatcataaagacagtgaagagataagtgatatattgagagacaatatttgcaaaacacccagtagaatgagcaaaaaaggttaaattctaattttttccatgtaaaaaactacaaattttcataatattaaaagttgggagaaaaaaacaagtctcaatgatatgaaacaacaggaaatctcattctctactggtacaagtgtacatttgtttcaactttttggaaaataatatggcattccctaacttatttaatatataatatacttatttatatataaatataaataaataaatatatttaaatataaatataaataaatatatatttaaatatatataaatatatatttaaatatataaatataaatatttatttatatttttaatttattaaatatatatttaaatatatatttatatataaatataaatatatatttatatatttaaatatatatttatatatatatataaatatatatttatatatataaatataaatatatatttatatatataaatatatatttatatatttaaatatatatttatatatataaatatatatttatatatataaatataaatatatatttaaatatataaatataaatatatatttaaatatataaatgtaaatataaatatatatttaaatatatatttaaatatataaatataaatatatatttaaatatataaacaaacatatatttaaatatataaatataaataaatatatatatttaaatatattaatataaatatttaaatatatacatatataaatgtaaatatatatttaaatatatacatatataaatgtaaatatatatttaaatatatacatatataaatataaatatatatttaaatatatacatatataaatataaatatatatttaaatatatataaatataaatttatatttaaatatatacatatataaatataaatatataaatataaataaatatatatatttaaatatataaatataaataaatatatatatttaaatatataaatatatttaaatatataaatataaatgtacttatatatatttaaatatatatttatcctatagctctcttggttccatgtacttttttccagtcatcccttcatagaggcttctctcagctgacttttatgccaatgctttcattaacttcatttagataacagttcagaccatagacaatcactgtccatgtcaggaattctagatgtggtaactaaaggcaaactaggattaccgtggccatctgtcttagtctgtttgtgttactataaaggacctgaggctgggtaatttataaacaaagcgatttatttggctcatggttctgcaggcaacacaggaagcgtggcaccagctgcttctgataaggacctcagcctgctttcatgcatggcagaaggcaaaggggagccaatgtgtgctgacatcacatggcaagagaggaagcaagagggaaaaggggaggtatcgggctcctctcaacagctggctgtaatgggaactaatagagtaagaacttattgctgcaaggactgcaacaagtcatttatgagaaatctgcccccatcacccaaacacttcctaataggccatacccccaacattgaggatcaaatttcaacatgaggcttggaggggccaaacatccaaactgcagcaccattctaccttcattaagaaattactgacatggcctgagagaggtggctcatgcctgtaatcctagcacactgggaggccaaggagggcggatcccctgaggttgggagttcgagaccagcctgaccaacatggagaaacctcctctttactaaaaatacaaaaaaattagccaagcgtggtggcgcatgcctctaatcccaactactcaggaggctgaggcaggagaatcgcttgaacctgggaggcggaggttgcagtgagcagagattgcgccactgcactccagcctgggcaacaaaagcaaaactccatctcaaaaaaaaaagaaaaaaaaaagaaattactgacacaactttggagcactcaaatgtctcatagttagactatttctgagctcacaatttgggagatttaaagaaagaaaaaccagcactaataaatagtagaaatataaaaagaatcctagagctacaaggaggccagataatgcaggttctaaaagcagaagtaagcagaaaactgttttactgatgtgggctggtgtcaataaaatgtgttacagtgttacagcggtgaattcactaaaacaggtggattatttttttgcatgaaataatttttagcttctttggatttgatcagcccatatgctacatttttaaatgtatcaatttgggttgaaaaaattaaataaccaaatggcttttatttttaaaaaggaaccttaacaatttgaacgttaggattccctcaatataacattttatctcaaaaaatatttattatacttattacagctcatatattggaatttaatttttaaaagatgcaaataaaatctctgctccatatttgaatgctcagcatcctccaaagtacggctctttcccctctactctctttctcttttttagcttgttattcaagagaacaaagtcaagaaataggagctatagtcactctttacattcaatttctcattatttctcagaagatactacctaaaaatctctcaaatagccttttttctttaagttacaacagtaacaagtccttgcgtgaatggaaatagcttatgaatttgtctgcctgcatctggttttgctcccaccaaattcatgctaaacattgccaccctgttgatctttacaaatgcaacaacgatttcattctcaccgtcagaatgtttttggctcttcccgatctactgtacagtgtgtgagttcttcatcatcacatctatgatatgagcctgcttttactttcagcctcatctcacgctattctctgcctctaaatttacatattagtaattctaccatccatttttttcttccttctcccaaccaccgcatttcatgtgcttcgaaaagagtcgaaatgcccctcgactggaaagcttttcctgtccagctcctctctccaagctgcccctcacctcctcctcgtgccattatacaatctgtcacgtggtcttccttttgcaggtggcattggttacaagcaagaagagctaacatccagtatttttaaaatagtatcattgttttacctaagtgtttgccaatatctattggacgacttgtcattcattgactcaggaaagaaacgttagagcaggtaaaaggctcatgagttctaaaactcaggcgaaggctgaagagactctagagatggaaaaaataccccgattctgagagaataatttcattaacagaagaatagcagtagaaaaacaagagaagcttcaatgttggtacactaaactcaaagctgtcaaacccaatgggaaaaggtacaacagaatattcagatagccttattttatttaagcatacatgaagtctatttgcccaaccttacgcagagtccaaagagatgttaacactctaaaataaaattagcaaaatactgagaaaggcatagtggcaacatgcacgaactacttgtcagtggccaaaggagagaatgggcatctcagccagtgtcagtgaggactgaaactgcctgatcatgagaaacctcccaccataatgacatggaatccaatacaaacctgggcaaaggggcaagaaccctgaattgatatcaagtggggacttgaaatatgaaatcaagatttagaaaattgaagttgtatttcttgtgaacacaacttgtggattgaaatatatacctaccgaagccaagactttggggaggggcggtagggaggctggagtctcaggtgctggtgttgaggtgctcagacccgcattaacaccgagagggccctgtggaaggtggcacaccttgtactgtggaacaggcagttactgataacttgtgctaattttttcttgtataatctttattttccatattgccgcaaagagagttagctgatttctaaaatttctgctaatctgataagtgaaaaatggtaaattgttattttaattgtatttttaaattaaaaatgaaatttaagctcttaaaaatatcatctggacattttaattttagctgatatttgtaaaatgcctttttagaggaaatggtcattgtttctcccagattgttttatcctggtgatgtatcacatgttctgtattagagaatttgttgtcttatgtatgacaagtactttcccccagtgcagcatcattatcatttccctttattttgaccctaaagaggtttttcacttacatttctttgtcatgctgcttaaatttccatatgtcgatttcaagaattgtttatttttgattttttggtttcatagcatattttttaaaatgctttctctctcaaaaatactaaatgtgttaaatgtataaaacatgaatgcatattctcttctcagatgtgcatggtttacttgttgaatgtgttctggcataaagaattaagtacagacccagctatttttttcctttcctattattttagcctcaggatgtattttactagcaagactgtgttcactgctgtcagttctgggcaaggtcctccctcccgccatggctatttacctatttttattcttcagatgaactttaaaataattttgtgaagttttactccccaccctaaaaaaaataaaatatcctggcattcttatggggtttatatctcatctatggaaccatctaaggaaaacttatattttaaaatatgaaagttttcaagaatgagacagtttctttgatttattcaagctttcttttaagtggttcaccttatttcaaaagctgtatccacttgtaggttctatatattttttgttacactcatcactaaacattttattgctcataatctttttttaaaattattatcatgattatttttggaaatgctgtattgccaaggctggagtgcagtggtaccatcatggctcactgcagtctctacttcttgggctcagatggtcctcccacctcagcctcctgagtaattgggacgacaggtacatgccaccatgcccagctaatttttgtattttttgtagagacaaggtttcactatgttggccaggctggtctcaaactcctggcctcaagcaatactcctgcctcagcctcccaaagtgctgggattacaggcctgagccaccatgacttgctttattatttgtattcttcatgtgaataattgacttccttatctttactagctttgtgccagtaatactttgacttgcttatattaataatgtcaccagctgtattaattcattactttccatatatttccattttcagtgaatctcttgaaatatgaagttttctgtgatataatttgctaataattatattttttcttggtttctattctttatatcactcaatttattctcttttccaatgtttcgaggacaggtttaactaattgttggaatagttagcaaaatttagaatgagcttcctatatggagttgttggcagcagtagagagaagcattgaattgaggcttctgttcagcctcactctgggtcatggacacttccactggttcttaatttttcttatctcttttgactttgctttctctgaagtctttgttgtgagacacagaaactttgaaatttcttaggcttctttctctttctctctctctctttctttcttgcagaggaaagcaaattttataaaccctgaaattccttgtaccaagttaagagctgtgcacctacaatggtggactgtggctgacgttttgcacatgtccctgctttaccaacttactgccaccccaaatctctattctggatgcttccatatagatttatgttatctctaagagttctcataaaagtgcccactccttttctcagactatactatttcagagaaaactggagatgagccactcaagcaactcgtggaaaattctgtttctgggtaacaatattcaaagtgtatggaatgaacctgcaccctttcttccatttgtgtcctgctgcttctacttatttttgtccagcttattgaatttggaggaagttaattgatcttttttatggaagcaaatttccctagaggacaaggtttttgcttaggaaagatagctcgctctaagagaaggactgttgaccagaaaaccagtcataaagctattgtcattgcccagttgaatgatgatggaacaatgggtgaggaaggagctaaataaattgcattccttgggcagcatggctgggctcagaggcagtaatatatacccttggtttatatattaaacactaatccacatcatatattacacaagatgctatcacaaaactattatttttacagaaaaatcatgtgaagtagttaatagcatctctaatttaaaaatactgtcctgaatcctctaatgctaaataattaattaatatcctcatagcttcataaatcttatagcagtttgaactcatgtctccaaataaagaacaatctgtaatttgaaccttattattggttcagtattctcttcaattaattattttggcagtcatctttttaaaacattaaacattttattgcatcggattttcttctgctcctactggttctctattgacctaagcaagcatgagctcttcagtaattttgaaactatataaccaagatatggtttcctagcaactggcatgcctaaaagcttcctacctctgtttcaaaatgtttgcagtctacaaatgttttctctcacattttagcttcttttagatttgtcttccagcacaatttaatttcaacaagtcaagtattatacagaatgcccacaaactttaagacttaagggcatcagatctgtatgcggatttacaggaggtgatgtacaacatgaaaggaaaattcacctttagaaagaaaatatcacttggttgaggttgagatgtgtatgaatatcctgtgtggagaatctctaaacagtactaacagctgccattagaagaagtgactgtgtctgcatgcgtgcaaagtcgaatatcccctttgcttttcagtgtaaaagagatgtcatagcagcaacccctcagcagccaggtagaaaaaaaataacagaaagtgtccatgtgtgccctctcttacactgagggaacggctgagcaaaacaaataattgacagtaggaaactaccagagcagaaagtagttagaagcagacattttagagtcatacagactttaaaatccagtcacatctttgctgatgactaattatgtgtatttgaggccgggcgccgtggtcaacacctataatcccagcactttgagaggccgaggtgggcagatcgtaaggtcaggggttcgagaccatcctggccaacatggtgaaactccatctttactaagaatacaaaaattagtcgggcgtagtggcacacacctgtaatcccagctacttgggatgctgaggcaggagaatcgcttgaacttgggaggcagaggttgcagtgaggcaagatcatgccacagcactccttcctgggtgacagagtaagactctgtctcaaaaaaatatatatatatatttgagaaaactatgcaatctttctccacttcagttttcttacttgcaaagtggttactggttattctttaagtctgctcagcatccaaatcctcttttaagcttgaaaaaattccccatcatatgaatcttggtggaggatggagtcccctccctcaatgaaaggttaaaaggctttgatgctagtgaggggcacctgctctgtactgaggacctcatgtaactatctctgggagtggaaccgattacgtacaacaaaattccattctttgggcagcattgcaacaatccccaaagtatcagtggtggaagtcacagaagctaatgagtggcagtagtgctggccatgttctcactgaaccggtcctccagtgttaccataagatgggggcatacacaagcttcattcctgtgtgtgcatcctccaagaccggattctcgctacctggggaaacttgttagctgtctactatgatgttaacacatttgttttttgcttgccaaccaaaatctactttcaggtgcttgcaactatgattcaacattatttatcatatagcaccattgtgaacactgaatacgttaatccaggttatataattagcacagaaactggaatacagcacatactcaataaatactaatggcattactaattacatggtattatttcttggctccttaagaactatatttcaagagataaatatgtattagaccatttcagcccccacacttccaaaggtttatgatgaaagagaaaagcccaagacgtaaaaaataaaaaataagaaagcagtgagaaaatgaaaactagtggcagatggaggttaattcaaatctgcccttttcgctttcttgagcaaaggattttaacctttctaaatcggagttcaccatctgctgtatgtaaataatttctaaactttaaggttgtagtgaaggtgacaaaaatatactcaaaacatttaacatattggcagacttgcataatgagattaataagtggtagctattgcggttactataattttgctttactcttttctcttattcaattaaagcagtacacacacactttgcatcaaatattaggaactgtaagaatttctactagatattagtttcttcaaatactttccattcgcaagtttatgtaaaactgggatgttaagtgtcattagatgcagcaggatattgcttttataatatatgcatttttaaattatgtcaaactcatgtgaatccaaaatatctgaaacatgtctcaatcaatttagcatgtttattttgccaaggttaaggacataaccatgacacagcctcaggaggtcctaatgacatgtgcccaaggtggttggtgtacagcttgcttttatatattttagggaaacataatatatcagttaatacatgcaagacttatatttcattccacctggaaaggcgggacaactccagccaaggtgggggtgagggagtgaaggagagcttccaggtcatagatagatttgaaaatgttttgattggcaattggttgaaagagttattatcagtagaaaggaatgtctaggttaagatatggggttggggagacaaaggttttatcatgcagatgaagcctccaggtagcagccttcagagaaaatagattgtaaaggtttcttatcagacttaaggtctgtgttgatgttaatgctgtgggggcgagtatagtgacgcatgtccaaccctttcttccatcatggcctgaactagattttctggttgactccagaatgcccttagttgagagtaagggtccattcagatggttgcagggaccttagaatttcatttttggtttacattctcccccttctggccaagatttgccaaaggcaacatcaatggccaccacatttttattttgtcccatagtgttgccagagtggcatggcggcctgccccaggtccatcctgttctttgatgggactccctgtggccaagggacttagagtctagccagataagaatggacatagacaggcattcattatccccttaattttttttaagtaattttttttaagttaaaagccaacaaacaaaatccacagacaggatacaaaactgacttctctttaacttctatgtgttgagctactataatcttggtattagttacagacttgtagtaattagctatacaaaacataagcattcttctgaaaattaaaaaaatacatatatatctgaaaaactcttaactgagagtattatagccaagaggttctgttatgaggtatctttatactctcagtaattacttacttttaattctataggaagtagtatattctttatggttgtgttacaggaaaggggtcccaatccagaccccaatagagggttcttggatctcacacaagaaagaattcagggtgagtccacggtgcaaagcaaaagcaagtttattaagaaagtaaagtggtgaaagcacagctacttcatagacagagtagggcattcccaaaagtaaggggagaaacgtgtccactctaggtacaatgtttgtgtatataggataaaaaaagatcatgaggagggagatgtgctctgctacaagagtttgtgattaattttcttaattacaatatttttgcaagaatcaatattattatctttaaagcaaaattaggagtccctttgttctcaagatatggggatattaggacactcccaagtcggagtctgcttagtaaacattatcaacctgttcccttaatcgtaaacatctagaggctaggaatgcctaactttctgggaatgcagcacagccggtcctagcctcattttcctaggcttcactcaagatgaagtcactctggttccatagactctgacatatctcccggctccctttaaaacaggacccttaatcctaagggttgcagaggaatgaagatccatcttctgtatctccttcaggctgaataggggcaatgatattcctgcctaactattagggtctcttgcattcagggtagagagaagctcattcagaaagcattggcatggtgaagttcgttcagagctgtgagttctgacaagaggtgatacctggaagattaatgtgtccaatttaagaaagcgttgaatgagcttgtcttgcatttctacacaaaaagtacgaccacaatatattccacaacagaaaagcaaaataagtgtaatcactccaagtaaactaaacgggaagtctttccaagaactgggtagttgtcggaaccaagccgatattgtacacaagttactctcggcatgattccgacttatacccaaaagtagaatgccaatccatgtctttacgttacccatcctttttgcttcttctgaacaggagttggaggttactggttggctcacaggaataaatgtgatcagtctcttctgttcctcagcctgtggaactccgtaagagaaaggtttaatttgagataagtggacctagctgtttattcccagaagcttacctgcaattggggtatcaagtaaggagaacttgatagggtcccttccatttctggggaaagttgatctgctagggattattccttccaagtttttaataggacccaatttcctgcttgggttgtaacaagagtctcctccttagtgggggaagggagtctttgatttccatattcagggagtgccttttgcacgtgtcctaagttgatcacataattctgtggcttgaaagtatctacgtctattaggaggtctgtagttacaaaaggcctttgacacatcatttcaaaaaggctgagaggcagatttcccttgagggcccctcaaacccataacaaggctacaggcaatacaggcagccaggtttctgatgtttcttggcatagtttggcaagagccctttttacagtttgattagctctttctactttccctgaagtctgtggcctcaacgccaggtgaaggtggtacagaattcctagagctgcagatatgttttgagtaattgtctctgtgaaagatggacccttatcactctgtaagttcttaggtagcccaaaactaggaattacttcctttaataggagtttagaaacctcaattgccttttcagactgggtacgaaaagcctcaatccaacctgtaaaggtgtcaacaaatactaataaatatttaatctctttacatgggggcatctgagtatatcctagcaatcttcaccagggtatgttcctttatgctgaataggccttactagaagaggaggcaaagattggttatttggcttattcagggagcatagttcataggcctgagttacctgctttactgttttaagtaagccttttcctataaaaagctaagacatcaattgaaacagggaatctcttcccaaatgagtagagtcatgcaaatacttaactatttcccactgattagcaactggtatcaacggtttgttttcattgataagccagccagaaggatcttgaattaaaccctgacctttagcccattcttgttcctctttagtatattttggttctgtcattactgtagctgagggtactagtatgccgacaagtccaactggctcccttaatgctgctgccttagcagctgcatctgcaaaagactttcctttagtcacactagaatctcatttttgttgttgttgagacagagtctaactctgtcgcccaggctggagtacagtggcatgatcttgtctccgctccctgggttcaagcaattctcctgcctcggtctcccaagtagctgggatttcaggaacctgccactgcacccggctaatttttgtatttttagtagagacaggttttcaccatcttggccagggtggtcttgaaatcctgacctcatgatccacctgcctccacctcccaaagtgctgggattacaggcatgagccaccactcccggcctagaatctcctttttgatgtcttatgcaatggattacagctacttccttgggcagaagaacagcatccaatagattcagaatttctaagtgatgttttataggggaacccttagcagttaggagtccctgttccttccagatagcagcatgagcacgaagtaccaggaaggcatacttagagtcagtgtaaatgttaattcttaagtccattcccaattgcagggctctaataagagctattaattctgccttttgagccaaggtaaaagctggtaaagcctgagattcaattacctcgtgctgactaatgagagtatatccagcttttctgtttccctggtgcacaaagctacttcccatctgcaaaccattctaccccaggactatctacaggctaatcctttaaatccagatggctggagtaaactattccctaattgtatacaagaatgatctagggggcctgtgcctgtgtgttcaggcaaataggtagctgaattcaaaatctggcatactttaagacttaaatcaggagtgtctagcaacaaagcctgatttattcacaggaaaggagaaggagcaatttttcacctgcctgtgatttccaaaagctactaccatttgcagctgagtcaacaaatccccttcccaacaagggagtgtggtattcaggagaaaaccagagtccctgaagagcagcttaaggataggtaaaatggcatctatgggcttgtccatctagtgaccatagttttggagtgacaggggcccaatataatgggtcaaaacaaagtaagcagtccagaaggaagttaatattcttaccctccaggtaacccacatcaagggttacctgaggcttctcaggagttatggctagttatccaatgagagctatggcagaaggtctcgggccccatcactcttcagcttgcctgactgctttggccatcattgtgataaggaaggggggcaggaaagtgctgaaaggagaagggcagatccctcaccagggttccaccccccgggcctgtgcccatggacctaggtgaggacaggctctcctgcctttgcgcccaaatgtcgcatttcccaagaccatcctggcctgccatgcccccatcctgtgcctataaaaactcagagaccttagcaggcagacacacacacaagcagccggacatcgagaggaacacatcggtggaagaagacacaagtggctggacatcaagaggacatcgaggggagcacaccagcacatccacaggccatcgaccagtggaagaacacaagctcaataaaactttgcgctcattctccaagctcacgtgtaatctgattcttctggtacaccaaggtaagaactcaggatacagaaagccctctgtccttgcaacaaggtagaggtagagggtctagttaagctggttaacataagctgctcatagacagcaaaactaaaagagcacatggtagcacatgcccactggggcttcaggagctgtaaacatccacccctaaatgtaaccaggggattggacccccacaacctgcccctctgtatgctcccctagaggtttgagcagcagggccctgaagaagtgagcctctccccgtcacaccccctgtgatgggcaaagggaactttatccttttctattggttggggtgccaatggctcccttcggagcgctgggcaatccctcttccaatggccagttttcttacagcgtgcacattgatttatggccaaggcctggtgactcagacacccagctttgggctttccacctttcaacctcccttgttcaggccaagacccaggcgggcaaccccatgtgggaggtgagcttaaggctggagccaagagctgcacctagtgggagtttcttcttgctctttctgcttcctctgctttgtccctgatattaaaaattaaaaatgccatatccaaaaagctgttcataggagtttggggacccatagctgcttttttttttttttttttttagcttcctactgatatcagggacagactgggttataaaacgttctcccaaaagggtttgcccttcccttgaggcagtctcagcgttcacatatttcttaattgcctcaactaaatgcctctgaaacaaagctggattctcatctttaccctgagaaacttccctaaccttgtcatagttaacatgctttttcatatatttcttcatcccttccaaaaagcaaatgaccacatgatctctcctccccaagtcttcactgcccctttgatagttccactctggaccaagatggatcttgatggatccatcaagatggaactgccatgcctcctgcttgatatattatggttcagattgtgagccaatacctcatctgcctgggtcctagctgttcccaaaacgtgttgtttctcttctgctgtacaaaacagagacaacaaaatgtgcagatcctgataagatgaactataggtcagagttaatttctcaaattcatctacgaattttcctggatcttcagagaaatagctgagcttctttttacatagagccaagtcagacatagaaaaggggatatgtactttcactgtgccttcttcctcatttgccacctctctaaggaaagatttcctttcagaggtttagaagaggcttcactacgagtggtactcactgggctaagttcctcagggagtggtgggtataaagtgggactagacaggtaaggaagagaggatgaagggctctcaatagaactttcagctggaccagagggagaaagggccgacacagctgaaggttctgctccaccaaaaaatgcctactgaactgcaggagcttgcatcacaggatcatctagtatgtctagttctttttcttcctttcctctcatcaaacacacatgcgcctgctgcagggttttatcctgactgagcagcaaaaatgcttggacatatggtatttcatcccatttttcttctcacttacaaaacaaatcgagttgaagtacagtattaaaggccttagttccagtaggaggccatttctcttgttttcccaaataataccgaggccaaatgtattacatagaaacaccagttttctcctcttaagtctattcagtttaaattggtctcaatgttcaaaaatatatcctagtggtgagttatttggaattgatgccatggttcccatgaaggaggcaggtgatgttgaaagtaaagttccaaacctgtgagattgtattgtcactggctgagttccactaaaaaggataggagaggtttttaagatcagctgcagtaatgagggggatccctgccaaaaaatggaattatcttattcacagtgtctgaataatataaatgaggcagccatgaatctcagatatatcacaacatggactccaacaatagaaatgtcgaataaggcaaaggaaatgaagaggatttagatgggaatgaccagggcaagcaggttctgggcaatagtggcaacatggattggacaagcaaagccagtttgcttgaatccaagaaaggaaagaagtgttttttgtgtgcaaaatgaaacaaaacggcaaggaaaaaaagtcccctgattttcatcctagtgcttctggatcacacctagttagcacaaaacataacagcagcaacaaaatataacctagcagcaaaaaaacataaccacatgtatctaatcttattgctcatggctatgaaataccaaaccacaatcagcaattttagagagggagccttcaatgccttttttgttcccaatgtttcacaagcaaatggatggaaatcaggaggcacacataggaagaataagttaaaatccctaagaccagttgaatgaagtatcctgaaaatgacagagaaacagagactgcaaacaagaaattgattcatgccacaaagaggacaaggcagattaatacaaagagcatggcagttaacatcctgtggtgccaaacttgtttctatctgagagagcattcacgctacccccctaaatcttagaatggactctaaccctgctaagtcaggtctctaacccaaggttggtcaagagtccttgccttttattgagagaagcctttaaccctctctgtcttaggagagactcccctaagttgggtcttctaacccaatcctcacttacccaaagtcagccaattggtgtgtgcaaatgactttcctttgggtcatggatctcttcaatatcaccacttccggtttgccaaaaagatatcaccggaccccaccacttacccaaattttccctttggattgaaggtttctgcactataggctcttcagtggtcaccagaaagacattacaggaccccacgacttacctaaagttagcctttgggtcaaggatttcctcactgtagtcccttcagtggttgccagaaagatattacaggaaagggatcctgatccagaccccaagagagggttcttggatctcaagaagaaagaattcagggcgagtcagcagtgcaaagcaaaagtaagtttattaagaaagtcaagtggtgaaagtacagctactctatagacagagtagggcgttcccaagagtaagaggagaaatgcgtccagcccaggtacaaggcttgtataaaaaggataaaaaaggatcatggggagatggagatgtgctgtgcttcaagggtttgtgataaaggattaattttcttaattactatacttttgcaagaatcaatgttattatctttatcacaaaattaggaatgcctttgttctcaagatagcaggatatctggacactcccaagtcgagatgtttagtaaatattatcaatctattcccttaactgtaaacatctagagtctaggaatgcctgactttctgggaatgcagcccggccagtcccagcctcattttcctagccctcactcaagatggagtcgctctgcttccaacgcctctgacagttggggtggatgaaaaagtgtcgtgtaatagctcagaaggcaaagtaccttgttttatcaattgtttaggcatctttgtacccacccttgatttggagggtccaactttgacctaattctatccctcaaatccaggcccttacagcctcacatgcccaccttttctatgacagtccttgggcctagagggagggtgcttgtatagtcttaaaagcaggccatttgaagtgaaaaacagattaggcccagtgtaatgctaaaggagggagatttgtatctctgctcttcagattaccatgattttagcttccttgcaagtaaaacaaggagaaataagattcgtatttctacagagtatttgtgtgtcagaacagaaaagaagaacctactccattagggtgccaactaaaaatatgaagaaaaattataatctggcactctctagaggattactgtagccaagaaataattaatgattcaatctgcactcagaaacaaaagtcggagctgaaataacaagtgttacacttttcctttgaaacaatttctctctctagccctccttttctattagagagaagatacagtaagaccaatctgtgtgcaaagtaagttttaggcttattatgcttggcctgattatttgcataaaatgcagcaagaattgattggctatataggctcattttaagttggctttgctggaactttacctaaaaatatattattctagtcaaagccttggtaaaataaccagtgtctctagttgtcctattttaaaagtaaagattcttactaaacctatgcaaataactatatcgtcataaaatcagaatgattatgagcagtttccatattttggagaactcagacagaaaagtaaacttgttcacaaaaatgtacttcaaccaatagctgtaaactacaaataacaaaagaaaaagatttgcttgtctcttctttaaccagagcatgggtttcaaacaggatgtcacttgttcaccttggaaatactatccacaagccaaacaactcttgttagatgagagctgtctatcaggcactgtccaacataacagctctagaatctatatgaggatatagttagaatcagcgatggtaggggggaaaggctacctgcttatgagtattctcctccttgcattccccaggtagcaagatactgcatcaaaaggatttgatcttatatcaaaagtttggaccaaggcactcaggccctttggttaatgtttatcttatttgcctcaacattgcccaggtaatgccatctttctcattataaactttggctttttttgtttgtttgtttttttgtttgttttagttctccaatgggggcaaatagtggaaacccatccaaaaatttctatcactcttctggggagagtcctttgactccctttttcctttccctttttatttttgttgttgtagttgttgttaattaccccgatgttttattaagcatctgtaagacccatgagggacaggaaatttgataaggcttctcaaacagttgtgtgattttgtggtagtgatgttacctggggtatccatggaaaagtgtaaccacccactgggttcaccttgcccgccacctagacagagacaattgatcaagacaggggaattgcaatagagaaagagtaattcacgcagaactggctgtgtgggagaccagagtttcattattactcaaagctgtctccctgagcattcagggattggagtttttaaggacaacttggtgggtggggggaagccagtgagccacgaatgctgattggctaggtaggagataaaatcataggaaactgaagctgtcctcttgtgctgagtcagttcctggctagggggggtcacaagatcagatgaggcagttaatccatctggatggtgccagctgatccatcaagtgcagggtctgtaaaatatcttaagcactgatcttaggagcaattcagggagggtcagaatcttgtagcctccagctgcatgattcctaaaccataatttctaatcttgtgcctaatttgttagtcctacaaaggcagtgtagtccccagacaagaaggaggtttgttttgggaaaaggctgttatcatgttgattaaactataaactaagttctttctaaagttagttcagcctgcacccagaagtgaacaaggacagtttggaaatcagaaacaagatgttgttagctaggtcagctgagttataattttgcaatggtggtttcaataggagtccccttaacccctaaatttactatgacctgtgtaatgggcatatttggtgggagaatatgctggttatcataaggtcagtctcatacgacttgcatatgaagcataccaactgcttcatctggtgtgctccacttgatattttacagggaaattcggtcagtcaccatctcagggcaaacagactgtacagaggcatttatctggtccaataggttagttgcaggaataacctcgtgtgccttgggatcacattattcagtagtgattgtttaatagtgagttgtggttcctgcatcaacaaacaagctctttccttctgcagcatttaaaattaagaattatgtccttaaattagtgatttttacaattcattatagtaaaggtttctcaagaagctgatgacagcaatctacaaaatggaccaattcctttacattataccctctagtttaatagttacttggtcttgcccttcccccacattgcctatcttcttgaaaaccacaggtctcagaggtaacatttgttgccctggcttaataatttttatccatttagttctacctgtatgttttcctttatcttaaagtgacttaaatagtttcttaactagaaaaaatattacattttcttcagcaaaaaaacacatccttgtattttataagcttcaccaaaaataccctttacactgttattattttagatcttaggaactcaaattcccagtgaaaaaaaccaaagttacttaatttaacacaacaggactttaagattttaaactactggagataattttgaaattaaatttaccaaattaatcttaccaaagataacaaaggtcatgtgacttaaaaggctaatatctaccagctaatatctgaacaaatatctaccagcctgataagcacttacttttttttttaatcaattgattagagctctttcatgtagtttggtggtgaaatatcacttccacattgagatgggatagttcccttgacctcttcagaggactcatgaagaggtggttcacttactcagcccacagctctcaaaccccttgtgggagtgggagtgagcaggtgagagggggcagagaccgggatgggtgtttctaggcactggcaggagtagaattccgtagcctggcagcagtgtccaggggttgcccaggacccccagagccccagaaggcatgtgttatagtgctgtcctttagctttgccattcatggatggcttaagtgttaaaacagctcagtggagagccagtatgacagcctcctgtacctgcacccaggttcttgtccatcatccaggaggaatgaagtggcatgaacaaatcggaggttggtgaatgtgaaggattttattgtgcagcagaagtggctctcagcagcatggggaactggaaaggggatggagtgggaaggcagtattccgctcaagttcagccaatcctggctgaactcctctccaacagtaatctctgatgattgcttgataaataaatgcaaatgaaactgtatgctgacaattcttaagatatttctaatactactttaccaataattttaaaaccagcttatttatgaaagatgttacctgaatcatgtgaacttgaaaagcatgtgggcttattatttaatttatgaatactctttagcttcaagccaatttgctactttgtggccaaaaccacataacgaaatacatgtacatacacataaacacacacaaatgcatttgttacaaacaaggatcttacagtttttacttcagaactctggccatgagagattaatacaaactcagcagtttgcaaaaacaataataattttaaaaacattgcaaacattggattttatgttagtagaaaagtaacagcagacttcaatcaggcagaaaagaaaacagagaatttaggaacattatagttagttgcaggtcaacctttgggctctgagttttccatgatgttatttgcccatcagtttaaaacgtacacaagaacagacctaatctgtaaccagctggagtattagaaaacctgttatgtccttccattttcacaatcacttgcaagtagaggtgccataaagctgggcaggttgaccaaggtgggtcattctccttgtctttcctcattcttaggtgatttgttttgcacatttttttttcttaaaacaaggaactggtctgtggcctagggtttagtgtagtggaacaagatgtgctgactgtggccaggactccacagtgagtcaccactgagtcatttctgccctcctattacatgcctcagtttctctctctggaggtctagcacctctgagagggctcaaaacatggagtggcaagctcctatatgtgtttcctggatgagcatttttaaactaatttttttgggagtttcctgtagggctgctgcacatcatgggaaggtcaaccccccagacactcccattcagccccagtcaccaaggagtaccttttggccagaaggagcaaaatgccctttctcttcagagctaagtaaactcaatctctcatttatctataaaaagagcgacaattcagttcctcatgcaaatgagcagagaagtcaatcaagactaattttgggaggaaaggtaatagagaagactatttagaatgtacctccaaattagaattaggatcataagcaacaactttcttggaggaaaaacaccagccaagactacttcctgtaaactgtgctcagctacccctaaatttgtagctctcatccgccattatacacaccaagatcaaatcctctcacattacaaggtcatctctggtacccacaaagcgaaagtggtcaggtaataaaatataggagagcttcagacataagaagaatttgcccacgactgttgaaacgccacaaagaaaacagagcaccccaaaagggatgagtggcgtctttgttttgagttctttcaggggcttgagtcattagaagccttctctagattttttcttggtactgaagacagcaaaggggaaagcaggaatagggtgaaagaaaagtaaacaaaacaaagaaagttttgtttttaagaagggaagcaaacatagaaaccaagtgcatggtttgttgttgttgttgttttcttctttttgaagctgtgagaaattctagccaattcagaagtcttgttgcccataatctgggattctcatttgaatttgacaaatttgagtagagttggtcaaatctgatgggagaaagaccagaacaacaacaacaacaaaaccaactatatagtctttgagtgttcttgtggtaaggagaaattaggctcaactggttgtcaattttaacctttagtcattaaggataatttccaagacaaaagtccccaattcagctacttactgggaatgagattggggatcctatggagggaggggagctcctgggtcttggcaaattgtcctattggtttgaaccataaggaaatctcaagctggtaccaagcaccgataggagatttgtcaaaagtcaggggaaactccactcagaatcccttcgtggttatcagtttgtcaaccccaaatacctgagacaggtctcaatcaatttagaaagtttattttgacaaagttaaggacacgccagtgacaccctcaggaggtcccaacaatatgtgcccaaggtggccagggtacagcctgcttttatacattttagggagacatgagatatcaatcaatacctggaagatttacttacattggttccatctggaagggcaggacaactcaatagtggggagcttccaggtcatagacagatttaaatgtttcctgactgacatttgtttgaaagagttattgtcagtagaaaggaatatctgggttaaaataaggggttgtagagaccaaggttttattatgcagatgaagcctccagcaggcttcacagaaaatagattgcaaacgtttcttatcagacttaaggtctgtgttaatgttaatgctggagggtatagtgaggcatgtccaaccccctttgtcatcataacctgaactggattttcaggttaactcaggaatgcccgtagctgagaggaggagttcattcagatggttggtggaccttagaattttattttttgtttaacttcagaaataaaacaaatgactgtgagtccttttcattttttttttatttgacagactagccttggggttgttaaatatattaaggaaagcatctatgtatgtctttttaataaactatctgagaagagctcacatactatgaagttatgttatcttgcattcgttctgttcagcatgtgaggcactaaccagtttgtatctatagtccgtcctccacatctgtgagttccacatccatggattgaaaatattctgaaaaaaataatttaaaaaacagcaataaaaaaaccacaattttttttttaaaaaaatagagtacaactatttatataacgtttacattgtattaggtattacaagaaatctagagattaaagtatatgggaagattgtgtaggttatatatatacaaatattatgccattgtacataagggacttgagcacttgtgcacttgcagattttggtatctacaaaagttcccggaaccaattccttgtggattttgagaaatgactattagcaaatttgtgtcatcatccctttgacttacagtgtaaaataaaatctttggcatgtgttcattctatatttgcatgagagtcatgttttttaaatttttaaaaatatgctttggcgtattaaatgctctatctagcaaacatattttagcaaacagattctgataatgccagaccatgctaaaaacagcagctatttatgttagtctagtttttcaaaccttgttaaataaacactggtaataacatttgaggctaattcttacaatagccagacaatttctttaatgaagagaaaagatttattcactaaatagatcccaggatgaatccctaaatcactagtgtactgtgtgattggtaactaacttatccattgaaacctcagattcttcagaatgaagatgttagactagttaatttctaatattagtagcttatctgtctgaatattatattttaaaatataattgttattaagttgcattttgaattaccatcttgattttttggtggatttattcaattaaaatgattgatgagttcaaacaaatcagaaaatatgtaaagactaacaaatagagatggaaaagttacagtgacacctaaactcatatctacttagaaaataaaatttgcttgagtattaagggccaaggaaaataagaaaaaagtttatccaatgaaaatggacattttaaatgctgggatatgtcattctcaatgcctggaaatcatagatcttgaactttcataggttaattatctgacctgacaaagacaagtttggtaaaattattggaaaagtttgttttttgtatcttcccacttacctcatgcattgcttctcaaagattgcttttcctcagtagtaccctggccctttatttagtcattcattcagtagatatttatgtaatgaaatcattatgacatgataccataagctaaaatcatagacctgaataagacatgcttttgtctgcaaatagctacagttattgagaaaaaagaaacaagtaagtagtagaagtaaatgcaatgtattatgatagaaaggataagggtagagaaaagggatttggcatgaatccagaaagctctcagaaggcaatacttaaactgaaatttgagaaaaaattataacagaatatgaggtgaaaagagaagagtattccaatcagaggaaataccaagttgatgatagagtgaagccacattacacatttagagaactgctaatatttattcacagctgaagcaaaaataggtgtgaaagtaacagaaagtgaaatcccagaatcaggaaggaagtgataatgaagagcttacattgtaaacttaattatttgtaaatgtatctggtaggaatgaaaaagcataaagcatgaaggtttaagctactaacatgacctactgccatttaaaaagttgtctatagcagcatttacagtgtgaaggcagagttggctcttttttttttttttgctctgatatgaacaataatgatgattataataaaggtccaagttaaggtaatgaaattgaaaatagagaaaacaaacttgagagagaacttgattaaagaggacttgaaagaaaacgaagagtcaatgagggaagagcagagatgagtgatcaccagattttgccctaggaaattgggatgataacagtgacattttccacgatgggaaatagccaaagttaagccaatttaatacctagaaccataaaggattgttaaaaattggtttcacgcaattggttttagatgttattatacactcaggcagagatttcaattaggcagtgatatatagatagcatgggagattaggattccaaatgtacatctgggatataattggcagcagaatccacagagatttaaatgagtttatctgggaagaacatattgttgaaggaccgcgtgaggctaaggatacagcctgagacatcaggaatatttgcaagccaagcagaggagtgtgtctcatgaaaagaaccagaaagaccccagggagttaagaggaaaacgaaaggtctgcttatatgtaagccaaagttaagtaagaatttgaagaaagaaaatggtcaaaagcatcatgacctacagaaaaatctaattaaaggcaaaaataaaaaagaccattatctcctaaattttggaatcacattaaactgtagttaacaataacttattgtgtatttcaaaataacttaaagagtggaattggaatcctcctaatacaaaggaatgataaatgcttgaggtgatggatgtctcaattaccctgatttgatcattacctattgtatgcttatatcaaaagatcacatgtaccccatgaatatgtacaattattatgtattcataatttcatgcacgtctgtgtgaagagaccaccaaacaggctttgtgtgagcaacaaggctgtttatttcacctgggtgcaggcgggctgagtccaaaaagagagtcagcgaagggagataggggtggggccattttataagatttgggtagataaaggaaaattacaggcaaggggggttgttctctggcaggcagagtgggggtcacaaggtgctcagtgggggagctttttgagccaggatgagccaggagaaggaatttcacaaggtaatgtcatcacttaaggcaaggaccggccattttcacttattttgtggtggaatgtcatcagttaaggtggggcagggcatattcacttcttttgttattcttcagttacttcaggccatctgggggcataagtgcaagtcacaggggatgcgatggcttggcttgggctcagaggcctgacattcctgccttcttatattaataagaaaaataaaacaaaatagtgttgaagtgttggggcggcgaaaatttttggggggtggtatggagagagagaatgggtgatgtttctcagggctgcttcaagcgggattaggggtggcgtgggaacctagagtgggagagattaagctgaagggagatcttgtggtaaggggtgatattgtggggttgtttgaagaaacatttgctgtatagaatgatgggtgatagcctggatacggtttgggatgaactgagaaactaaatggaataaaagaaggagaaaaacaggtataaaaggtctaagaattgggactactcaggacatctgattagagagtgcctaaggagattcagcgtagtcctgtcagcaaagattatttattaacttcaaaagttaagagtggcagtttggggatagcactaggagatatcagctgtgatggcttggagaaacagtgtaaaccggcagtgtaaacaagagcagggcatgtatgagtagttgagaacggtgaataggagtatgactagacagaagatagtagggatgacaagttttttggggggcacagtctaagttggtctggtgtctggaatgagactggggcctaataaaaaggagcgtctatacaggagctcaaatgggctgtaccttgtagcattctgagaacaggtctgacttccgaaaagggaaagtggtaaaagtattgtccagtcctttttaagttggtggctgagcttggtgaggtgtgtttttaaaagacctttagtccgttctatttttcctgaagatggaggaccataagggatataaaggtttcactgaatgctaagagcctgaaaaactgcttggctgatttgactaataaaggctggtctgttatcagactgtatagaggtgggaaggctaaactgaggaattatgtctgacagaagggaagaaatgactgcggtggccttctcagaccttgtaggaaaggcctatacctatccagggaaagtgtctacctagactaagaggtattttagttatctgactcagggcatgttgagtaaagctaatttgccagtcctgggtgggggcaaatcctcgagcttgatgtgtagggaagggagggggcctgaataatccctgaggagtagtagaatagcagatggaacactgagaagttatttccttgaggatagatttccacgatggaaaggaaatgagaggttctaagaggcaggctagtggcttgtgctatagcatagcttgcctttgctggtgtgtagcgattaggcctggtggaaccaccatcaataaatcaagcgagatcagggtgaggaacaggaaagaaggaaatatggggaaatggggtgaatgtcaggtggatcagagaaatacagtcatgggggtcagatgtggtatcaggaataatgtgggaggccggattgaagtccgggccaggaacaatggtaattgtgggacttaacaaagagtgagtacagctgaaggagccggggagcagaaagtatatgcgtcaggtatgaggaagaaaatagattttggaagttatgagaaatgtagagagtaagttgagcatggtttgtgattttgagggcctctaaaagtattagggtgtcagcagctgctgcacggagacatgatggacagcctaaaacagtaaggtcaagttgcatggacaaaaaggctaggggacacgatcccggtccttgtgtaagaattctgactgcacagccctgcacttcggctgtgtgtaatgaaaagggttgggatgagtcagggagagctagagtgggggcagtctctaaagctgtcttcagggaatggaaagaggagtggggaaaggatttaggatctatggggtcagctaggtttccttttgtgcgtttatataatggttttgttaggatgtaggtttccttttgtaagtttatataatggttttgttaggatggcaaaaccaggtattcaaaggcaaaagtatccaactatgcccaggaaggaaaggagttgttgttttgtagaagcggttggggtttgggagattaatcagacatgatcagcagggagagcatgtgtgtttttatgagaattatgctgagataggtaacagataaggaagaaatttgggcttgactgaagtaatgggggctgtctgtgaagctttgcggcagtacagcccaggtaatttgctgagcctgatgggtgtcagggtcagttcaagtgaaagtgaagagaggctgggatgatgggtgcaaaggaatagtaaagaaagcatgtttgagatccagaacagaataatggattgtggagggaggtattgaggataggagagtatatgggtttggcaccatagggtggataggcaaaacaatttggttgataaagcttagatcctgaactaacttgtaaggcttgtctggttgtaggacaggtaaaatggggaaattgtaaggagagtttataggcttaaaaggccatgctgtagcaggtgagtgataacaggctttgatcctttcaaagcatgctgtgggatgggatattggcattgagtggggtaagggtgattaggttttaatgagatggtaaggggtgcatgattggtcgccaaggaggcagtagaggtatcttataattgtgggttaaggtagggaaatacaacaggaggacgcaaaggaggctttggattgggaggaagggcagcaatgagatgtagctgtgatccaggaatagtcagggaagcagataatttagttaaagtgtctcggcctaataagggaactgggcaggtggggataattaaaaggagtgctttaaagagtattgtcaaagttggcaccagagttggggagttttaagaggtttagaagcctggccgtcaatacccacaacagttatggaggcaagggaaacaggcccttgaaaagaaggtaatatggagtgggtagcctccgtgttgattaagaaggggacggacttaccttccactgtgagagttacccgaagctcggcgtccgtgatggtctagggggcttccgaggcgatccgcagcgtcagtcttcagtcgctaagccaagaagatctgggaaggagtcagagagccttgggtcagagttctaggggctctgggagtggctgccaggtgagttggacagtccgatttccattggggtcccgcacagatgggatgtggcttaggaggaatcctgggctgcaggcattccttggcttggtggtcagatttctggcacttgtagcaagctcctgggggaggaggttctggaggaatgcctggctgctgcagttcaggcgtttggaagttcttgtgtgctggagatgtggctggggtttgtctcacagtggaagcaagcaattgcaacttttttctattattgtacaccttgaaggcgaggttaattaaatcctgttgtggggtttgagggccggaatttaattttgggggttttatttaatgtagggagcagatggggtaataaatgtattttaagaataagacggccttttgacatttcagggtctagggctgtaaagcatctcagggttgctgccaaacgatccatgaactgggctggatttttatatttgatgaaaaagagcctaaatgctatctgatatgggataaagaaaaaggagcattaaccttgactatgcctttagctccagccacctttttaagagtaaattgctgggcaggtgggggagggctactcacggaagaaaactgtaagccacaccaggtgtgaggaggggaggtgataaaaggattatagggtggaggaacggaggctgaggaagaattgggacctagttcggcctggcgaggaagggagaggtcagatgggtctgtagaaaaggaagattagaaagactcagcaacgattggggttgggactgaggggacaggcaggagggaaagaaggaagatttgggacaagttgcattgggaacagagactaggaagggaccgatgtgtaaaagaatgcctggatgtcaggcatctcagaccgtttgcctattttgcgacaagaattatttagatcttgcaggatggaaaaattgaaagtgctgttttctggttatttggaactactgtcgagtttgtattggggtcaagcggcattgcagaagaaaataagatgcttagattttaggtcaggtgagagttgaagaggttttaagttcttaagaacacaggctaagggagaagaaggaggaatggaaggtggaagcttgcccatagtgaaggaggaaagcccagagaagagacgagacagggagaagtggtggggggttcttgccctccagaaaagcagagaaggggttggggcacagagataggaggtcggggcatggaaataagggatcggggcacagagatacgaggttggggtacttgccccttcaccagaaaagcgggacttgctgctaagggtgaaggagaaggggttgggggtttcttgccccccagaaatgcagagaaggggtagagacatgcggagaaggggtagagacatggagagaaggggttggggtacttgcctctcccccagaaaagcgggacttgctgctaagggtgaaggaccaaggcaggtgtccctgtgtggtctaacacctctgaaacctgggtgaataatcagagaggtgtccctgcaatgattaaacaccaagggaaggctgccttccctagttcgtgactggcgccagagttttgggtccatggataaaacgtgtctcctttgtctccaccagaaaatgaaaggaattgaaataaagagaagggagagattgaagtgtggcaccaagattgaaaggagaaagaggttgagggatagtgagggaggttgaagaagagagtaaaaagaggctgcttaccggatttgaaattggtgagatgtttcttgagctggttggtctgaggacctgtggtcataggtggatctttctcacggagcaaagaacaggaggacaggggatggatctcccaagggaggtcccccaatctgagtcacggcaccaaatttcatgcgcgtccctgtgaagagaccaccaaacaggctttgtgtgagcaacaaggctgtttacttcacctgggtgcaggcgggctgagtccgaaaagagagtcagtgaagggagatggggtggggctgttttataggatttgggtaggtaaaggaaaattacagtcaaaggggggttgttctctggtgggcagagtgggggttgcaaggtgctcagtgggggagctttttgagccaggatgagccaggagaaggaatttcacaaggtaatgtcatcacttaaggcaaggaccggccatttttacttcttttgtggtggaatgtcatcagttaaagcaagaacgggccatttacactttcttcttttgtggtggaatgtcatcagttaaggcggggcagggcatattcacttcttttgtaattcttcagttacttcaggccatctgggtgtatacgtgcaagtcacaggggatgcgatggcttggcttgggctcagaggcctgacacataataattaaaaatagagaatatttacaaaagtcaatgattgtcttcacttacaaatgacaccagctatggatctttttttgtcaatttggcttggattattccaaaatagtattgtcctgaaggtacaggagagaggtccagagcacagagaggtagtttattttttcatttttttgcccgaaataattactgttctgaggaagtgatacaaaagtttaattaaataccaatatttctaatgtgacaatttacttggagaaataaatattttaatatgcttttctatttagtaattgttgcatgaaaataaaaaaaattgttatcaagttcacccattgaaatctgcatcatgttctacacaagttttgctaatttttgaaagctggggtcactcagataccttattcttaacctgaaagaccctcagaccaaattttattctgtgaaatatttttaacttttgagaataatctaattgcttatataaatatttatcaaaaatagacctttgaagtgttaaatggaaagaaaggaaaaccttagataagtttgagtttatttgtgtaaatgaaaacaaaaatgatttgtgaatcagcagctgtttgaacaacagcaggtttagaaagctccaaccaataacatgatctgacagcatttacaggaaacaaaagtgcagtgtagagacagctcagttattgataacttggctacagtgcctcctgaaattaactaaacctcagctgctagagttaaactccatattggtttgatgtgttaggcttagtgcaggagcctcattccacggcctcctataaattgtatttaacaaaacaatctttgaacatttcatatttttgaaaagtaaaaagccaaatgtttaaatgttttgtgagtccctcccctatatatatacattttttttttctaggggggaacagagtcttgctgtgtcacccaggctggagtgcagtggcatgatgtcagctcactgcaacctctgcctccctggttcaagcaattctcctgcctcagcctcctgagtagctgggattacaggcgcccaccaccatgcctgactaatttttgtatttttagtagagacagggtttcaccatgttggccaggctggtcttgaactcctgacctcaggtaatctgtccccctcagcctcccaaagtaatgggattacaggcgtgagccaatgctccaggcctccaccatactttatttgtgaaagacataaccaacagatcatcacaataaaaataatatttatttatttatttatttatttttgagacggagtctggctgtgtcgcccaggctggagtgcagtggcacaatcttggctcactgcaagctccacctcctgggttcacgccattctcctgcctcagcctcctgagtagctaggactacaggcgcccgccaccacgcctggctaattttttgtatttttagtagagacggggtttcaccgtgttagccaggatgatctcgatctcctgacctcgtgatccgcccacctcggcctcccaaagtgttgggattacaggcgtgagccaccatgcccggccataatttttattttttaaaatttattttaattattttttgtgggtacaaagtaatttttattttttctttttgttggtacatagtaggtatatatattttgggggtaaaaaaaatgagatgtttagatacaggcatgcaacgtgaagtaatcacatcattattgtgattaatgaaagaatggcataaccatcccctcaagcatttattttttgtattatgcttattttcttctaaaccgtatcaactgcaaaacaaacaaaagtcaggttatataatttaaaatgttaacttattatatcttaactggaagccttagataagattccttaaacagatctggctgtgcttctaagagcaatctaaacaaataatataaatatctatataaaatatataataatataaaaaaagaaataacacttgttgctaatggtgtcatctatttcatatggtgatagaacaacataataatcctccatttcttgcaatgttttgatgaatattactccagattactcacaagttctaaggaatatattattagaattcttcctatgctagaacatgtatgtggaagaaactcatttcattttcctagattccttccacagtatccattgaacagtgttgtagattcgaaattacattgttccattccttttcatgtattttccttggttctggttctcttgtttttcctgaatgctgaaagcagtttttgagcatctctgactttcacaagtaagtgtggatttttaaacatcttaatgaaggtgcagaaaattggccaattgtccttctttctaatcaccattttcactccatactctggcactgtgagcagtcactctcagatttgtcttcagatgctgttcttctgctggctgccagccaggaggctgtaaagaaaactatagcccaaggcaacgcgactcagtccacaggactgctgcttgattccttgaggatttgaagtcagagctccttattagtggcctcaggatttatgtttcaggcacaccttgggcctggtaacacaggccttgtgaccaaccaagtaccacaagttgcaaaaatcaatctgcttttcattgaaggaggcttgacttatttactatgtcatctaaatttctttaaaataaactgatagcggacacatcacatttatcttcactagcccaacctgatcatttctttgaccttttttttttaaagtgcttctaaactcatatttaaaaattactattgccagttttactccagtatttatttaatttttcctgtgtgtggtaaaatcagaacaggagaagatataacactatgttttgttaactgagcattgtcttttattttttgttcatttttacttcctttctatttcatatttatgtgtttacttctatccatcactatattagccatttttccctaatcatggtctttttcttaatttctcagattcttttgagaggaaccctagcccatattttgatgccaaatctgcctaaaaatcatccacgtatctcacttgttccttaagacaacattttcagcattcttttcacttgactagtatccttcaggatgccctctgagggctgatagagatctgctaaggcaaaaccacaaaacataatataaatgagagctttattttatagatggcttctgagctcatatcagtaattttctactagactattgtctatctctctaatctacaaataagattgaaccagtcatctgagatgtgaggatttgatttaaaaaagaaagaaaaaaaaagattgaaccaaattagcactcttaaagagccaaactgttttaactgcatgaggaccattctactaggtacctgcacgaaaaggtaaaaaagtcaaaatgccatagctgacccaaccttttcattctgtcacgctggcctcaggatagagcaggttgaataatttggttattctttatagattatataaatttatagttatataaatttatagtttcagtgctttcatggctcctataatgtggctgaatgattgaggttatgggtcaggagttcaaagtaaaggtctgttgtgattggcatcagatgatttcctctgcccttgccactagatttgtctacctgaacaaatccagcttctagttgatgccttgttcatatggctgctactgcagattgggacagtcaatggctgatttcctctgaaaatgcagttcagacattgggattctaagtatttatagatcaataatcttttttacccagcttcaatgaggtatacttggcaaataaaaattgtaaatatccaaggcatacaatgtgatatttcaatctatgtatacatatattgatacatatgaaatgattaccatgatcgagctaattaacatatccatcacctcacatggttatatatattttttgtagtgagaatacttaacatctactattttagcaaatttcaagcatacaatacattgttattaactatattcaccatactgtatattagggcttcagaacttgcatttaaactgcaagtttttaccttttgatcaacatctccccatttctcctaacctcaaccctggtaaccacctttctactctctttctatgagttcagcttttttgattccacatatatgtgaaatcacatagtgtagggttcttgtcacacgaccaggaaagattaggcttgcagacacatagaagggtgagaaaaatggaatttattggtcaaaaaagaaaaaaatggaaacagagactctcagcaaagtaagagtcctgctagcaggtttcccacctcacagattgaattctaggttaccacccaggaagaggagaggccaggctcttccttgctgcaaaagtgagcaaacctcccgaggccccagcccagtgcacactcactcctcccagtagtatttgtctttctgtgtcttgctcatttcacttaacattatgtcttccaggttcatccttattgttgcaaatggcaggatttccttctttattaaggctgaataatatcccattgtgtgtgtgtgtgtgtgtgtgtgtctcattttgtttatccattcctctgccaataaacatttaggttattttcatatctgtttttgttaatgatgtgcaatgaacatgggaattatcttttcttcattagaaagaaaaaaaaactttacataacattattttggctatttaccttgtagaactctagaaataatattttcatgttaataaatggttactgctgtaaccacccaatgggttcaccttgcctgctgcctagacagagccaatttatcaaaacaggggaattgcaatagagaaagagtaattcatgcagagccggctgtgtgggagaccggagttttattattactcaaattagtctcctagagcattcaaggattagagttttgttttgttttgttttgagacggaatctcgctccgtcacccaggctggagtgcagtggcgcaatctcggctcactgcaagctctacctcctgggttcacgccattctcctgcctcagcctcctgagtagctgggactacaggtgacagccaccatgcccagctaattttttttttttttgtatttttagtagagacagggtttcaccatgttagccaggatggtctcgatctcctgacctcgtgatccgcccacctcggcttcccaaagtgctgggattacaggcgtgagccaccgcaccctgaacaaaagaaggatgaaagatagaaaaagggagagaagaagagagagagagagagagagagagagagagagagagagacagacagacaccggtctgccagaaaccaaagctcagttccccagcatcttgggatgtgaaccgagtcaagggagggcccctgtcaggaccattcccacccaaaccaagacacaaaggtgcccaccagaaaaccaaggctcaaccctctagcgtcgtagagtaatgggcagagtcaaaagagggatgcccttgtcagggctgcttccctcttaccagaaccagaacgaagtcaaatctgacctacctgaccccggagtcagaagctgaggactcagatgttgaattttagggcacccacacggtagtcgatccgctgtcctccggaagacggtcacccttcgggaacctgaaaatttcgtctttgcaggtggcggcttccctacaggccagccgtccttccgggggagcccggagtgagaccggctcttgcccgctggcgttaaaatttcgctggggcctccaactgttgtacccgagcaagttagaaaaacactacagtttgagacgaattaagagtcctttattagccggcaaccgagagacggctaacactcaaaattatctcggctctgaggaaggggcttgattaactttgataccttggtttaggaaggggagtgggggatctagttaaaacaattttacagaagtaaagtagtcaaaaagttaaaaggataaatggttacaggaaagtaaacagttccaggtgcaggggctttaagactgttacaaggtggccaggcgcagtggctcacgcctgtaatcccagcactttgggaggccgaggcgggcggatcacgaggtcaggagatcgagaccatcccagctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaagactgttacaaggtgatagacccggggctttgggcattatcaatcggacgaattcctgggaactgcggatatagcttgccacagtatcctatcagttaattgcattcttggatgtgctgggagtcagcttgcacaagttaagtccttgaggaaggggctgccagtgaaagagccaagatggagtctgtctggctctcttagctaagggagagtcaattcaggtggaaacaaggctaggtgattaaaggaaaagggagagtctaaaaacagagttagtaaaaaccaggttgggcattacaaatggaatattatttaccacttaagagaaatgagctatcaagccatgagaagacagagtggaaactgaaatgcatattattaggtgaaagaagccattctcaagaggctatataatggaaagatttcaactatacaacattctggaaaaggcaaacctatagaaataataaaaaagcagttgttgccagtggttagaaagaagggagggatgaatagactgagatcagagaattttgagagcagtgaagctattctgtataatactataattgtggacacatgtctttatacaacttgacaaaacctatataatgtaaaatgccagaagtgaaaccctatgtacgctataaactttgggtgacaatgatgtgctaatgtaggttcatcagttgtagcaaatgtaccactctggtgggggttgtcaaaagtggggaaaactgtcctgtgtggggactgaggatatatgggaaatctctgtaccttctacacaacttggctatgaatccaaagttgctctaaaaaataaaatctactcaaaaaaagctgtctgaaaactgggtagttcatgcattaaccaagtacgcttttattgaataactactatatgccaggcactatcacccttgcctttgaggagttgatactctagagcatgaaaaaaattgtcaagtgctattgtgataaattttattatagaaaaaaatgagttgttttgcaggatacagtctccaaaactcaaaaccacaaagacaaaaaggtatgtggttgtttctacagatatcttttctctatttctgtagccgttgaaatcactgccctccatgaaaggggaaataccacatctgataggtaaatgtagagtggagtgtgtaaactaacaggagagttttcttctaatacatcacgaagttgtctacccataacagaagtggcagtggaatatgggcgaataaactaagtacaggttgagcattctaaatctgaaaatctgaaatctgaaatgtactaaaatccaaaacttttgaacactgacatgaccctaaaaaatgctcgtttgcgcatttcagattttttaaatttgggatgctcaactggtaagtataaggcaaatattccaaaatgcaaaaaataaaaatggaagtctgaaacacttcttgtcccaagtatgttgaataatagaaactcaacctgtacctctgttgcagattaaaatcctgaactgtgatactcttgcagaatggaaattttagtcatataaattatttgcttataatatgacttggagttacactgctcattacctatggacaactaattttccttcatttactgttcagttatcagagctataaatatatacatactacaatataaagttttgcccatactgggaaatgtaattttttttgtagtcaactaacctttattattattattattattttttattatactttaagttttagggtacatgtgcacaacgtgcaggttagttacatatgtatacatgtgccatgttggtgtgctgcacccagtaactcgtcatttaacattaggtatatctccaaatgctatccctacccactccccctaccccacaatgggcccaggtgtgtgatgatccccttcctgtgtccatgtgttctcactgttcaattcccacctatgagtgagaacatgtggtgtttggttttttgtccttgcgatagtttgctgagaatgatggtttccagcttcatccatgtccctacaaaggacatgaactcatcttttttatggctgcatagtattccatggtgtataaatgccacattttcttaatccagtctaccattgttagacatttgggttggttccaagtctttgctattgtgaatagtgccgcaataagcatatgtgtgcatgtgtctttatagcagcatgatttataatcctttgggtatatacccagtaatgggatggctgggtcaaatggtatttctagttttagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatgatgagcatttttatatgtgtcttttggctgcataaatgtcttcttttgagaagtgtctgttcatatccttctcccactttttgatggggttgtttttttcttgtaaacttgtttgagttcattgtagattctggatattagccctttgtcagatgagtagattgcaaaaattttctcccattttgtaggttgcctgttcactctgatggtagtttcttttgctgtgcagaagctctttagtttaattagatcccatttgtcaattttggtttttgttgccattgcttttggtgttttagacatgaagttcttgcccatgcctatgtcctgaatggtattttagtcaataatttacaaggattgaagatgaatttctactacccaaatactgatgtaaccttgtgaaaaaataatggagaaaacagtagcagatatctttctgagcagaaatgctttcaaatataagtaaaaagtccaaggttcagtgatttaaatagatgttattttttaacataaagtaaaatatgatattggtagttgctatagttcagtggtcagcaatgtcattaaatccccgatctgggagttttttcttgtatttctgcctatgttgtccattcatcatcatgtttgtttcctcatggtcacaagagggctgctacagggcaatatcagggctgagttccaggcaaagggaacatagaaagacaaagtaccagctacatttgtctctttcattagtcaagcaaaagtcttcctagaagcttcccataggagttaacctaatatgtcactggaaaggttgcagagaaaatcaagtttctggcaaaggacaataggatagttttgactgacttaggcaaatcgtgatccatgactaagggctggattcccttacaagggagatgagagatgggtatgattgttcagttgaaagtatatttgatattctgtcatcagttgaaagtatatttgattgtctgccacctaacctcatgcactaatcccatgttttgcagtggtcagtcctgtctcagacaggaggaaacagagctattgcccattctgggtgctgatttcccaggtaaccagagctctcagtcccccatcttcctgtttgatactccacatttgcacattaattctagggctacgtttccaaaaatctttgcattatagacatgacttgatgctttgttatggaacaaaaatgttggcaacagaagaagcagtaataaatatcataggaaatttatatttttaattattttttctagcaaataaaatggtacaaactatttcaagtcctctcagaagaaatgttaaaattcacagcaagatgacattattagattagcagatatagtttcagaccagtggttattaaaggacaataaaatatcaggaagttgattagggtctatgcatatcagttaggcttcatgtataacgtcttggaaagagatgttaatagttggaaggtatcaaccgagaaactgagttgattcttcccatcctgctttcaataaaaaaagtagttgtggatagtgtgaatggaaaatcttgggggccccaaaattactaaactaagggaaaagtcaagctgggaacttttcagggcaaacctgcctcccattctattcaaagtcatccctctgctctctgacatagatacatattctgattgcctcctttggaatatgtctttcacctgtgatttggaagccccctccctgctttgagctgcctctgcctttctggatgcaaccaatatacttcttacatatattgattgatgcttcatgtttccctaaaatgtataaaaccaagctgtaccctgaccaccttgggcacatgtcatcaggacctcctgaggctgtgttatgggcacacatccttaactttggcaaataaacctcctaaaatgattgagacttgtctcaaaatttttctcaattgacaatagatttctgattaatcagatgaattcaaagacaaacaggcctgtgaaattatagaattatatctttaaaaaagaaagatatatgattcctcttttaggagaaattcatgcatttgaaaaatatttttaaaaaatttaacaaggaataaatttatagttccatagaattcaagaagttttagcttttgtaaaataaaatatgaaaaggcgaaatggtaagcacaaactgaatgaaaacaaacacgtgaacaaaaatagaaaaaaaatggcttgagggaagataattggtaaggcaattaaattgtcatagcagaatccaaatcagcattaaatttcaaaaacattgcacatatttaaacttgggtgaatttgagcttgaaactatgggctggccaatagtcacaaagggaaaaaaaatacaattactacaaattaacatttaacaagtgtggccaaagctgcactcaggacagaagttcccatccccaaatagttcatgtaaaaaggaacaacgataagaatgctcgctattcaatttttaattttaataaaagaaaaataacaataaggctaaagcaaggaaatggaaggaaagaatagaactgtcaggggctggaaggtagggcgtggaaccagaatttagtgtaataagaaaaatgcaatgcttctgcaaatctcttgaataaatagagacacggcttatttaagaaattcttgaataaaacttgtaatataccggacattattctatttaaatattatattatttctgacttctccccaaggtattattacactacctcttacagatggaaaaatctgaggtacagagagattaggtaattttctccagttcagaaaggcagggccaggcgcgatggtttacgcctgtaatcccagcactttggtaggcggaagtgggcagattgcctgcgctcaggagcttgagaccagcctgggcaacacggagaaacccggtctctactaaacacacacacacacacacaaccacacacacacacacacacacacacacttagccaagcatggtgacgcgtgcctgtaatcccagctacgcgagaggctgacacatgagaatgcctgaacccgggaggcggaggttgcagtgagctgaaatctcaccacttcactgcaataccaggattaaacctggtagtctgtctcttggctctgagctcttaacattaagctatgtaattgatgtttctgaaatgtatcaataaataggaagtaatttcaagcaagtatcaaaggcatgcttttgagactagaaaaactaattgtaaattgtattttaagaatattcaagattattttggtttggaagaataatagaggttgattttactaccacttactatgaaacacaattatgtgtttttatgtgtaattatattaatatggtaatattaccatattagtaattgattaataattaatatggtatttcataattagactatatggaatcatcattacataatagaaagtaacaaaattaaccttaatagaatgaaatatacataatgatgagatttcaataaatcacgagaggataatttagcaaatggacatgtttagtctttaaaaaatttctgatgtataaaatgaattacagaaacattttatgattgttttaaatgaaagaactacaaaatctataagtgaacatttatctaaacttgcaatgaatgttattttctatgtataaaaaatgacaaattgggaaattgacagatttaagtataaaatgttacaaggttcaacatggcagaaacatcacaaaaataatgaaagagtaacctcagaactaaaatatattaatatgttcaaagtatatacaaaaagaaaaaattaaataaatatcaaatccgctctactaaatccattaaagaaaataacaaaacccccaattttaaaagtaaaaggcaattctaaaaaaacagacctgaaaaaaagggaactcaaatcatgaacaaatctgcaataaaataatgaccttgttatgaaagaaatacaaaatcaagcaacaacgaagtactatttacatgatatcaaattagcaaagttttttagaaagcatgtggagatatctctgtgagtgaggcactcttggacttcataacacacataatgtactgaagtcttcacaagcacttttgaagaattctgtcctaagagtttttggctttgtttttcaatttgatgtatggtgtagtagtgatagcatgatgtctaagcttttattctcatcttaggtgaacccctactttgtgtttgtctgcacacacacacacacacacacatacacacacaatattcaagactgaacacgtagaaagcaaagtgcataaaggaaaactgtagcatacaaaagcttacttcaaaaggagggagagtgagagagattctgcctctagcaagcacaaatgcacagtgcataatttattgaacaatttctttccaattttacttaatagcttgcattgttcgaggcaccaatgttagctctaccaatttgattgcttttttatggcagagaattacaatgctgtgaagtccattatttttatatcacatttaataagctattcattttacaattttgaagcagaggaaatgaaaacttgtatctctggcagatgggtattctcaatggcttctatatttaaaggaaaatgaagcctcaataccttggttactcaactgtttctaacaagcaccgtatatcactgggtcatgctttcaggtactggccagaaaatcttacagaaattagaatgcttggagaagttaagaatatcataaaaacaaactatgaaatggcaatataagaaatatcaaattgacaaccccctccctaaatcaaagttcttttacattaaatttacatcaagatcacaggaacaaataaggatttgtctcaggagtgttatttgttcttatttatcatgacttcttttctaccttcggccattttagctggccagtgaaagagtggcttttgttatttcagcctgttttggttactttatttgatcagactcataaaagatgtattattaggtatgtgattcaataaatcattaacctgagtaaaaatttattgctcttcatatgatatctatattttgaacaatggttttaaaatgctaaaaatcttttttaagcataatagagaagtcaatgaatattttagatgaaaagtaatataggtagactagtttgtcgtttcttggcaaagtgaaataatatcttacagagataatgtgtttgtcgtctgtggaatttggcttttcagagatatacagcatatttcacatgattgatatatctcacgtgcaatgtctagaaactgaataaaattctcttttagatacagacagtgaagcactatctgtctcaatccattctcccaaggtaaaacataaaaagaaacatgagttttatgaaaagggttttctccctttggtctgtgaatagcttgatattgaggttcaaatttacttttaagtcctcacactctgtaaattctataagtataattttcttagaagtttcaacttatcaatatcctatagaatggtgaaaaaaagtgtaagagtaaaattaagcaatgttttccaagatcgtcaaaaccataaaagcaacctatcatagtttcccagggctaacttaataaggtatcataaactaaaaggtttaagaaaacaaaacattattatctcagttttggaggtaggaagtgcaaaatcaaagtgttagtagtgtcatgctccctccgaagcctctgggcagaggatctttccttgcttcctgccgtttcaggtacccctggatgttccttggcttgtggcaacatcactcctatcttcacctccatcttcacatggccatctttcctctgttttcacatgtctttttataaggacacagccatattgaattaagactccccctcctccccactatgtcctcgttttaatttgattacatctgcaaagaccctgtttccaagtaaagccacattcacaagtactgggagggtaatatttcaacatacccttctggggaacacaatttcatccataacattatcgtgacctttgagaaaagcactgtttccacatttcaaaaatagagatattgaaattcagaattaaacagctagtaccagagtcaagtttattctatcaagtctgggaataattaccccacggtcctgaatctaatcaaagaagattaatatactttcatatcagagatgttaactatatttagtgtccttttttcttgacttttgtctttagtttcctgggaatatgtagttaactgagtttttgagatgtgttcatattcttatgagcagtatttgggtttcatagccactaattacaaaaagaaagaatttagtaggatatgaataaataatgaataaaataagcaagttttgaaaaccaaatggaacctttatagtaattatattttggaaacatatctagttttttttatctatttcttaaaatgttgatatgaacactcaaactcattatttttggtagaaagtacatgttcccttttgaaatgtcgtaatatccttttaatgtcttcaagtcttatatagattaaaactatggaagatttgctgtgacatgacttttgttacttctctattataagtgtaatataaaatgtaaatattgtaaaaaatgtaatgcaacaaaattccctttggtggaagtaaaagtattcatattaatgatgtagggaaggcaaagctttacctcaaccttcataaggtccccagctgggccttattaaattaacgtaagatagattatcagaagaaaagcctacaaatataatacaggtgttttttgtttgttttaactttcattttaagttgaggggtacacatgcaggtttcttacataggtgaacttgtgtcacgggggtttgctgtgcagattatttcatcacccagctattacgcctagtactgattagttatattcctgatcctcttcctcctcccattttacaccctccaataggccccagttgttgccctctatgtgtccatgtgttctcatcatttagctcccactaatttgagttttaatttgacacaagagccctcataaaaggaagacccgaagtcacagagttgaacactcatatactaaatagaacaaacagtggtaattatgggaagtacctaaatgatgtggagaagttaaaggtaataagaattattttgagaaggtctgtttttaaagactgtgattccttatgaaagaatatttgttcagggagaacatctttcttatgggagtttttacatacttttctcaggaagaaaaggggagatcagaattcatttctagcatctgttgcttcttgagtgcctttggctcaaaataatctttctgacaaaatggcatatcatctggtgtcatacactgttaatcttcaatggcatacattgtgcgatcctcactaacaatgtacaataccatttataattttaatggcaaattttcaaaaattattattcaacaagctgataggtatgctataaaaatcaaatcaaaggcaatttttaccacctttctgaatactcaccaattttcacaaatttgcagtgtcagagaactgacaatttttttctggtgcaaagaaactggaaactggacagatggaaaacaggcttattggagcatcagccattgcttgactgctaagcttgattttgaagttgacaaatgaagaggggtttactttttcaacactttctctttgagcatatccctaaaattaaggcattggtcagtgaaattaaagaacacttgtatactaagtagaacaaaaagtggtaattgtgggaagtaactaaatgacatggagaagttaaaggtagataagaattattttgatgaggtttatttttaaagactatgattcctcatggaagaatattagcattaacagttacataagtattcatttcagttgtcctttacttgttatatgcttagttttccagttaagtaaattattttagccactgggctttaaagaatatttaatgggagaatacatactcttgcctgcctgaacttgtttataatattgcttaaaagcacaccttatacttttttaaacacttaaataatttatacaatcaaaaaattttaaaggcacacattcaacaaaggcaagcttaaaccaaagcaataaacattttggttgacactccacctgctctgatggctgagggcatattgaattagcaatctagaacttgagatttcatgcccatgcagagacaggagatgacgccttgggttcagctgagcagggaactgatactgagacacctgcatgcacctagaatcgtcaacaagccacaaattcaataaagaatttgtggatggtgactcatgcctgtagtcccagcattttgggaggccaagacaagaggatcacttgaggccaagagtctgaagcaagtctaggcaagatggcaagactgtctctacaaaaaatatttgaaacttagctgggcatagtgatacatgcctgcagttccagttactcagaagttcaaggctaaagaatcctttgaggccgggcgcggtggctcacgcctttaatcccagcactttgggaggccgaggtgggcggatcacgaggtcaggagatcgggaccatcctggctaacgcagtgaaaccccatctctactaaaaataccaaaaaaaaaaaaaaaaaaaaaaaaaagccgggcacagtggcgggcgcctgcagtcccagctactcgggaggaggcggagcttgcagtgagccgagatcgtgccactgcactccagcctgggcaacagagcgagactccgtctcaaaacaaaaacaaaaacaaaaacaaaaaaaagaatcctttgaatccaagagttcagtgatgcagtgagctgtgatcaccactgaactccagcctgggtgacagagtaaaactgtgtgtcaaaaagccaaaaaagaagtggactagtagaaaactagtcctacttacacaggaaaagaacaggcaacagaacgtgcgtgcaaaagggtcacatgtcagacttaatgaagattttaaagcagccattataaatgtgttccaagaagtaaattagtgcttaaagaagtaaggaaagcatgatgacaatatcttaactagagaatatccataaataaatagaaatttcaaaaatgaatcaaatgggagttctggaattgaaaagtacagtaagtgaaaaaaattcattgaatgggctcatcaggccgggcgcagtggctcacggccctgtaatcccagcactttgagaggccgaggcaggtggatgacttgagcccaggagtttcagaccagcctgagcaacagggtgaaaccccgtctctaccaaaaatacaaaaattagccaggcatggtggcgtgcacctgtagtctcagctactcagaaggctgaagcaggaggatcacttgaacctgggaggcagaaattacagtgagccaagatcacgctgctgcactccagcctgggcaacagagcaagaccctgccacacacacacaaaagggctcatcagattatttgaactggccaaaaagaatctgcaaacttgaagatagattgatatggatgatataatccaaacaacagagagagaaaagattaaagaaaaataaacactactttacagtaacgagggacaccattaagtgaatcaacatattcacaaagtactaaaagcaaagaaaggggaaaggaggaataatattcaaatatataattaacaaaaacttccataatgtgatgaaaaacattaatctacacatttaaaaagctcaaaaaactgcaaataggacaaacagaaagaggacaccctatcataataaaaatactgaaagcaaacagcaaagagaaaatctcaaaagcagtaagagaaaaacatcaagcactaaagcaaatactgatatcgcttaatttatacaagctagaggtattcatataatgtaacagaatattaaaatattgcctgtattttacattctttagatgcttttaatttttcaaagtgctccaaaattctaatattcgaaagtcaaatctaagaataaaaagattaaatataactggaatctaaagacagacagatggactgagtgaaattcagcagtaatgttttttaactcatcctggttaatcacttccatgtaggaacctttataaatcatttgacctgacttttcatgaacccataatgtaaacctcaaaagtaatgtgtaactaccattccatttgcaatgatgcaaatttatcatttttttaaataagcaaaataatgttaaaaatgtaaaataataaataatccaagaaagaaatatgttttatattctctttataatacttttaaattagcatttattggcaaaagacagcatcagctaatggaaagaagacataattgattatttaaagatcagattttaatttctgactgccaatgactaacaaaatatatttgtttgaacaaaattctgtgagccttaatgtttttatatatgaattaagcatattttcttgagacccaaagacataagtcacagtaaaatgaactgtgagatatgagtaatttataaaaattacttttaatgcaggctgtcttatggtcattgtacttttccaaaccagaaattctgtgaagatggatgtttcacctgtgtaaaacacctcatctataaggcttatcaaatcatacttgggctgggcatggtgggtcacacctgtaatcctagcactttgggaggccaagatgggtggatcacttgaggtcaggagttcaaaaccagcctagtcaatatggcaaaaccccatctctactaaaaatacaacaatttgccaggtgtggtggcgtgtgcctgtaatcccagctactcaagaggctgaggcaggagaattgcttgaacccaggaggcagaggttgcagtgagccgagatggtgccacttcactccagcttgggcaaaagagtgaaactctgtctcaaaacaaaaacaaaaacaaaaacaaaaaacatacttgacaggaaccaatacatcttcttttgtaaattgaaagcattgaagagtgatgcattctttgaaatacaaaatgcagttctcaaagttatgttcttttgaactttaattaaatatgtattttcctctttaacacatatgccaagaaaatgaaatattcaaagcaataagtaatgaattataaaacaccaataggcaaaagaagaaactcttggctcctcaaagttgcttattctgatgaaaaaagttacattttataaattacatttgtttactgatttgaccaaattcaactttctcttccttcctacctcacacagaaatacaaatttctaataaaaccactatatcaaatcgactacataattggaagtaaaacacttctcagcaaatgcaaaagaaagaatggaaatcataacaaacagtctctcagaccacagtgcaatcaaattagaactcaggactagaaattcactaaaacccacaaaactacatggaaattgaaaaacctgcacctgactgactactgggtatacaacgaaattaaggcagaaatagagaagttctttgaaaccaatgagaacgaagagacaatgtaccagaatctctgggacacagctaaagcagtgttaagagggaaatttatagcactaaatgtccacatcagaaaggaggaaagatctaaaagtgacaccctaacatcacaattaaaagaactagagaagcgcaaacaaattcaaaagctagcagaagacaagaaataattaagatcagagcagaactgagggaaatagagaaacaaaaaaacccttcaaaaaaatcagtgaatccaggagttggttttttgaaaagaataacaaaatagatagaccactaaactaataaagaagaaaagagagaagaatcaaatagataaaataataaatgataaagcagatttcaccgctgatcccccaaaatacaaactaccatcagagaataatataaacacctctatgcaaataaactagaaaatctagaagaaatggataaattcctggacacatacaccctcccaagactaaaccaagaagaagttgaatccctgaatagctcaataacaagttctgaaattaaggcagtaattaatagcctaccagccaaagaaagcccaggacaagacggattcacagtcaaattctaccagaggtatcaacaggagctgttaccattctttctggaactattccaaacaataggaaaagaaagactcctccctaactcattttatgaggccagcatcatcctgataccaaaacttggcagagacacaacaaaaaacgaaaatttcaggccaatatccctgatgaatatcaatacaaacatcctcaataaaatactggcaaacaaaatctaacagcacatcgaaaagcttatccaccataatcaagtcagcttcatccctgggatgccaagctggttcaacatatgcaaatcagtaaacataatccatcacataaacagaaccaatgacaaaaaccacgtgattatctcaatagatgcagaaaaggccttcaataaaattcaacatctcttcatgctaaaaactatcaataaactaggtattgatgggacatacctgaaaataataagagctactaatgacaaacccacagccaatatcatactgaacgagcaaaagctggaagcattccaaggcaggccaagacaaggatgccctctctcaccactcctattcaacatagtattggaaattctgaccagggcaatcaggcaagataaaaaaaaataaacagtactcaaataggaagacaagaagtcaaattgtctctgtttgcaggtgacatgattctatatttagaaaaccccatcatctcagcccaaaaactccttaagctgataagcaacttcagcaaagtctcaggatacaaaatcaatgtgcaaaaatcacaagcattcctatacaccaacaaaagacaagcagagagccaaatcatgagtgaactcccattcacaattgctacaaagagaataaaaaacctaggaatacaacttataagggacatgaaggacctcttcgaggagatctacaaaccactgctcaagtaaataacagaggacacaaatggaaaaaaaattccatgctcatagataggaagaatcaatatcaagaaaatggccatactgcccaaaataatttatatatgcaatgctattccaatccaggtaccattgactttctttgcagaattaggaaaaactactttaaatattatatggaactgaaaagggcccatatagccaaggcaatcttaagcagaaagaacgaagctggaggcgtcatgctacctgacttcaaactacgctacaaggctacagtaatgaaaacagcatgatactggtaccaaaacagatatatagaccaatggggcagaacagagacctcagaaataacaccacacatctacaaccatctgatcttcggcaaacctgacaaaaacaagcaatagggaaaggattccctatttaataaatggtattgggaaagctggctagccatatgcagaaaacagaaactggactccttccttacaccttatacaaaaattaactcaggatggattaaaggcttagatgtaaaactccaaaccataaaaactctagaagaaaacctaggcaataccattcaagacataggcatgggcaaaaattttattactaaaataccaaaagcaattgcagcaaaagccaaaattgacaaatgggatctaaccaagctaaagagattctgcacagcaaaataaactatcatcagagtgaacaggcaacccacagaatgggagaaaaattgtgtaatctacccattggagaaaggtctaatatccagaatcttcaaggaacttaaacatatgtacaagaagaaaaaacaaccccatcaaaaagtgggcaaaggatatgaacagacacttctcaaaagaaggcattcatgcagccaacatatgaaaaaagctcatcatcactggtcattagagaaatgcaaattaacaccacaatgagataccatctcacgccagttagaatggcgatcattagaaggtcaggaaacaccagcctggccaacatgacgaaacccagtctctactaaacatacaaaaattagctgggcatggtggtgcacatctgtaatcccagctacttgggaggctgaggcaggacaattgcttgaacctggaaggcagaggttgcagtgagacgagatcacgccattgtgctccagccttggtgacagagcaagactcctcaaaaaaaaaaaaaaaaaaagtcagaaaacaacagatgctgacaaggctgtggagatataggaacacttttacactgttgatgggagtgtaaattagttcaaccattgtggaagacagtgtggcaattcctcgaggatctagaaccctagaaccagaaataccatttgacccagcaatcccattacctggtatatacccacaggattataaatcattctcttataaagacacatgcacatgtatatttattgcagcactatttacaatagcaaagacttggaaccaacccaaatgctcatcaatgatagactggataaagaaaatgtggcatataaacactgtggaatactatacagtcataaaaaagaatgacttcacatcatttacaaggacatggatgaaactggaagccatcattctcagcatactaacacaggaacagaaaaccagatacctcatgttctcactcataagtgagaattggacaatgagaacacatggacacagggaggggaacatcacacactggggcctgtcgggggttggagggcaagaaaagaagggagagcattaagacaaacacctaatgcatgcagggcttaaaacctagatgataggttgataggtgcagcaaaccaccatggcacatgtatacctatgtaacaaacctgcacattctgcacatgtatcccagaacttaaagtaaaattaaaaaaagaaaacatgcacacactatatcctagcatgttttcttttgtatatccaatttatgaacaaaagctatacacgtgaaatacataaaaatgacattttttgagattatgttattcttgtagttttcaatggaattatcttttactgtaaaactaaatgacaacaaacaaactgaagtgtcttttaaattcttctgccccctttctccatttccacttttatccacactaatcctccccaacaccactattcagatcttaggagaaaaggcgaatcattgacattctgatggcaagaggtttttttttttaagcactgtgctcagcaagagttaaaacaaagtaaatcaatcagaatgaataaataatcaaatattctcatgtttgtaagtgctccttccaactctgtaacaataatgatcttcaataggtcaggattgactccttctaattttgtcatttactatctatatgaccacctacttttttttattagtttattcgtctataattgtatatcaggcactatattaagtactttaaattaattatctaattttattactattttataaaggaaagaactgaggctgaaagaggatgttatttgcccagtatggtaccttgagtaagaattatgagatgtgaccacataagactgttggtctttaaatagcagttaaaatcactggttaggcacaagaagttgagcagctggtaaacatcccttgcttgattccgtctttctgcacggtaggcacaatcataatgtctatctcctagagttatcatcattactgagtgagatgagtttatgtgaacacatttagcagagcatttgtcatgtaataagcaatcaaaggttaatatacataggcacagagcactcctaaaacatttcatccatgtaatataaatgccaaaatttacaaatcagttataatagagatggtctctccatcaccattattaattccattgcacttattcagaagcaaaagtgaatttgaacataatgagtgtattctaaattatagaatctgaaaattcttttctatgcagtaataattcaaaagcattggttgtacagtctcaaaaaagagaatttctaaaactttttgtttttcaaaattaagggaatattttaaagtatttgtcttattatcattttcttttccaataatagagaaacttatgaaacccagtatataaagacagtgatgggccaggaacccaaaatttaagttccaaactatacaaatctaatatgctggaaaaaaatcataaaatgaacacatctttcttactgtagctccaataaatattctaattacattaacataaattagctcattaatctagacagtaacctatgaggtatgtactattataatttctggtaacagataagaaaactgaggtatagaaagagtaagtaacttattcagggtcacacgtttaatgagattcatagctgcacaaataagaggacccacaagaaagttacttaacctccctgattttctgttctcaattgtgaataaaggggttaaaaatgacacagaaggtagaattttaaaatcggacttacttgaatcacatcccttacccaatgccattttttacagataatttgatgggtactggtggctgtgagacataagcaaatatgtaaacctctggtattgctaaagcaaatgcctacatctttccttgatgtaagactacatattgtggcccagatttaatatatgaggtctctaagtgagccattcagggtatcatttacacaataaaaacctttttaattttgaaacgtctctattttatactcatataaatgacattttccaatggaccatgcctcttaaatccatattttcctagtttgtttgccataagcaactcagacagagcatgtacaccttgctaaaaagcatcttaaagcttcgaattgtccactacctttccacagaaaatagcatcaggaagcacatttactaggtgacttcatcaggcagtttctccccaggatgcccttggttagaggacacggctactaaaccattttatcctgaagttgaattcgattatttccaaactatctttcaaccctatcattgtgttacttaaaagtcagttgtgttataacttatgagtctcgtatttgacatgttaaattctcattaatactctaaataatgtagtatattaaggagataagcatggcaaaatactatagctggaatttaattctttagtatagaacctaaaatgttaaatatttttaaacagccctgaaatttttgtcatagaactactcagtgtaatattgtcagccaaaaaagtaataattcaaaaagcaattgtaaaagcttcataagtgcacaattttttttctcaccttgtctggaattgaacagccagagattcaattatagcagtcagaaactcatacctcatcatatcacggtaataatgcattatcttggaaaaccaaggccaaatattggctatatcttataagcaacatattgatttttcaaaacggtttatataggtcaaaacacctcaaaatcatgttactctttcagaaatatgagaaaattttgtgacatttaattttaaaatacattaaaaagttttactggcttacaatgatcacatatatatgttttcactatgcagtcaaaatgataagcagctatgccaaaaacagactgagaaaaaaattatattttttcctaggttctctactaatttgcatttgcttcttgtttattcattttatcatcttccggcaagtgatagctgacactgaagtgttcagaaaaattttggtgataagtgtaaaattaatgataagtataaacagtctactcaacttaaaagggaaatatatttatactgtgtaatattatatgaaggattaagtagataaagtagaaagacatagtaaaaataaaagtagaagtaagaaaatattaacaaatagaatgatgagtacatcccagctttgggttaaatgcaaggatgtgtagacacatattatgcattacacacttatgcttatattttattatttaaccatatcagtgacctatgttttttcaattgtcacttgttttatattaagtttacaaatttttaaatcatgcatgtggattttcctttgtggtttgttttatttatctatagttataatttcctttctcttttagtcgtgagagaaatattcactttattttcttacagtttgagtttcactctttatatgaaagtcattaatccatcttaataaaaacagtaatgagaataaattcacggtcagttagaaaatgaaggatcgaacggcaagcgcctggggccaagaaagagcagctcctctgaaaaatggcagaagcagttttccatgccccaaacaggaaaggaagagtgtatgagacttatgagtctccattgccaatcccttctggtcaggaccatggtcctcagaaagcaagatattcaatgctggaatgattaacaacaatgtgattgtgaggaatgcagaggacattgagccgctctatggggaaggttcttttggaaaaggtattctttcaagaaactgtccaaccatcacagtttcagatcctaaattggttgctaaatggaaagatatgaagacaaacatgcctatcatcacgtcaaagaagtatcagcgtagtgttgagtgggtggcagagcggatgcgtagacagggacaggatgagagtgcggtgcgcagaatcctcaaggattacttgaatccgcttgagcatcgccctgtgaaaaggaatgaacaggttcaaatgcatgatgagcttaactctggaatggtctccaacatggaaggcacagcggtaggagagagaccttctatgataaacggggactctggaaagtcagttgttatgggtgatcccagtgagccattaggctgcctgcaggagggctctgggagcgacccaccaacagaaggctttgaggaaagcgtgggagaggacgcttcacctctgcccccagcatgttactccaaacacgatgctctcgtcctccagtctggccctcaccgtgaggacagcagccagcattttggtctcctgcatgctggggacagagggcctgaccagtacgtgctggtgcaggaagccaagtgtgccgtgagcgagaggaaggatgccccaaatgaggaattggtgcaaagaaagagactaatctgcagaagaaatccatataggatcttttgagtatttgcagctcagcctagaagaggtcttcttcctggtctatgctctggaatgttttaagtatttgctatgagaaggagcctttaacgatagcgaagctctggaaagctttcaccgtagttcagcttacgttcaggaccacctccatggtctaccattgcttgccaagcaatggctagtgcccaaagtggggctcaagtacgggacagatttactgttatattggaaaggccctccgttttaccatgcaagctattctgtcgttattgagctagttgatgagcagtttgaaggctgtctctgcaggcctttcagttggatgtccctggctgccttgagcagagtttccgttaatgtctccaaggaactcatgctgtgctgtttcattaaacccgctactatgactgacaaggaaatggagtcaccagaatgtatgaaaaaaattagagttcaggaggtgattctgagttgatgggtgtcttcacaagagaggagtgaccaagacaaactttaacaattcaacctcaaatttctaatttcaccaacaactatttattgcgggctaggtaaaaagttctttttactgtaattccccattaatttataagttttaaagggcctggtgctcccagcaccagacaatgatcagtgtttttaaagataaattacacaggggaggagaaagagccctgtgttgggcctgcagattctgtccttgcattggcctcttccaatcctgagcctcgtgcctctggcctcagtctgtgccctcatccagtcactggggaggttggactagatgagtggatgaatcccgaggggactcttccaataacagggacatttattctctgattttacctgaaagtggcagtagtttacatttatacagtacagtttatgaagcactttcatacacaagcatctcttgctacttacatctaagctgttccaaaaagagtgctagcaggtttaacaattacaggatctatgttcctttattttgaatggaaaaaattgttatatgtctcagcatatccaagaactttaaccaatagctcaaaacatttaaaaatctctttaatatctaccaaggatttctgtataacaaagcctttaaaatatcagttacctaattatttaattctcaaatgaactcatttgtaggcatgtttatatacagaacacaacaatattatacaatattagataagcatatcttcactgaacttgttacaatgagtgatgaaataatgtttggagacataatgaaagcaattaacatttagcaaaatataataaagcctttgtttaattggtgaaataaaacagaaggatcatctacaattgtaccattttctgaagaaatataaattttcaagttggcttatgaaggattagaaaatgtaaaaaagccaaagattaagggagcccattttagctttcaataaataaattcttcaaatattattaaattaatggtttgtgaagaatatatagcatgctaggcactagtgagcgtgtaaactgctacagactttcagaacagcaaattagcaatataaatcatgaaccataaaatcttccacaccaataattatatttccaggaagctatactactaaataatctcaaatttaaatgacgacttatgaaccaaaatattaattgtaccattaataataatactgaagagttggatgaaatttaaatgtccaacactgggaagatgactcagtaaattgcagtatatttgaggggggaaatatgagatagatttcaaaattaattttactaaaaatgttaatgccatgcatatgctcaagatttcttgaaaaatctatgatataaaattatatgtatagtataatctttttacataaaaggcataaagtttataatttttagttaacacacaaatatacttacatagaaaaattaatacaagaaaatgcactagaatgagagtagtaattgcccctcagaggagaaattgatatataattttttttaccttctttcacttttctttgtcttccatgataatacctatcacgttatttcattcttcattacagtagctaactctgagtcctaactaacacagtgatttttgaggctgactttctctttaataaaatggaaaatgatcctttaacaacaatttataaaagtgttaaatgatcttggagggtccttcttgttttaccaaaagaaattttttcccataaaaagtaaaaagtctcaatcctgaatggcaccctgttataatctagaaactgccatgctgggttaatttactatcgcacagcccagaaatgatctcattgacagagatgccaaggcaccattttgttccttggtcatcctctatatgatttccccaacatattagccatactttccaaagatctctagcttaatttactaactcattatggacttagagaaatgtgaaatgtgtattcaattgtttctctgaacatttaagaaatgcaccaacaacatttcttacaaattttttttttgttctatcaacaatattactttgttgtaataaattaatgagtttggtgcttctctttcaattgcgtgtgtgtgtgtgtgagaaagagattcttaatgatattcacactgtaaattttaatatacagctactctttttgtaaccataaagtctgagtcattttagtgatggtgaagagggatatgataggtttgtgggaaagggtgagccaacagcccatctgaacaccaactgttgagtgcccatttccccaggtgtcactggatttctgggaaacagcttcctagactttagtgtcctcaattaaagagcagacaactatggcttttctctctgtctgtggaggttagggtacagaaataatctcagttgaaagccttccttaatggcagtgacataaagtgagagagtttttaacacactgtctctcctcaaatcacctacagttccagattcccattgttaagggatcttgggggtattgcttttctggctataaatctgtggctggtggcacctttgcccaagttttgctcggacctgctgggcttgttccacccacttggcatggcaggctgcacttggttcatgctaccagcctggatcccacaccttcaaggagagtgtgagtcaggtgtggagcagtgaggggtgtgtgagcaagtatgggatcctgccagtaagcagtcatatacaccagcttctgccacagcatgagcagctccaggtgccagctctgtgaggctgtggctgcaccaggtgcactgcaagcagcttccccagctggcactggggaatgtggtggtgcctggaagcttagagatgctgggaatctcagggccccaaagagggagtcataactcttgcttagggagctcccaggtgtggggtcctcaaagggctgcagctcttctctccttctcttcactggcaatgtggcatgcaaggagcatgttttagctctgttttggttacagctcttttagcctcttcattaagcaggtcccaaattattgtcctgcaaccaggaagaatgaggtatgcagacaagtggagagtgagcaagatgaaggggagatttattgagtgacagaacagctcagaggagatccacagggggcagctctcttccacagccagggtgtctagtccagtgttcaaagcagagaggatagctcctctgcagctgtttgtcctgttgtctgctctgccctggctgagcctgaggcttttatgggcctcagagaggagaaagggcatgctgattggtccatgggtggccatgggtgggactggaaagggcactgcaagttcccactccaatctgtaatactggcagaccagcccccacccttcaggccctccctggtctgaaggtgggccctcaccaggacccactgccttccacccagaagcctgtctgcctcctgcaactgttcatggtgcccaggctgcttgcaccaaggggtacctgcaagccagtgctgagccaccctcagcccccaaacctcagcttccctcccctcccccaaccccaccactcatcagcacccaaagtctggagagggccaaggcagcagtgggttggtgtgtcagtgctgcccccaaggatgcacacacccagctgagctgtgacagcgccccaagatcagagttggtgccaggagtcgggagaagccagggagggtgagcagatactcctgagcctgtgggggaagtggggacctgcccaggcccccaagggtgcagactgcagagattccaagtcctgtacctgggagggcaggtctcccgccagctctgtggagcctataggcagccctagctgtgcctcctcacagcctggggttggtgctccaggtccacactgggcccttctctgcatgcccctctgtggctgaccccactgcttccccactggcagtggctcggcccagccccattgaggcagccccccagggcaatgggctctgggagtgctccactcatccctggctcccactggctccgtggagtgtggcaccaccctgggcccagttctggctcctcccagtgccagccccacagcagtggcaggtgagggggtgatgtgggccaggatccagagtggcagaggctctgggcctggggcggcagtgtgagggtaagggcagtgcagccagctgtcttggggatgcagtgcacaggggtcccaccaccaccactgctgtacctgtaaccactccctctgccactgctcacacctccccactgcagccattagtggcagcagctgctctagatggcctgtcactgccatcgccatcttgcttccatgtctcccacatctaaacctgagacacctctgcagcccctgcaataaattttgcagttctctggggttttatgttcctcatattcatcccatttaccttcctgcttcaagtgctttttcctagttgctggccccctatgtgaagctattcttgattatcatgatagttataggttttgtttatctttttaataaatactcattctctgtcatttctaaggatttaagttcaaagaagtgatgatactttaataaaaaaattaaaatcatctcccaaatgtaccttagatcattttattcagttttaaaatcccttaattctagaaaatattgttatacttaaaaaccttggggaaatttttttggaaaatacatttagttctaaaggtcattttagtaaggaagatggttctccaatcttctttttatattttctgtatttgttttataaaagtcagatatgcttattgatacgtatttcaaaattctggtttcgttattgaatcagttatacaatttgtaaggtgcttactaatgtttacttggttgtcatgggtttccagtaattgaattgtgtagtatttaatttcttgtaggctttacattttttctttcactttttaatatttcccattacattggctaagatttcccggaagaaaattataaattgattatacttatagtttttgtatctaattgagttgagctaaattttaaaattgctatgtgttttctatcaatttcttcttacactttaaacaagtcttgattgataactattttgcttaattattaaggcaaaaaatgtgaaaagctctgacttttatatcattgttacagaatacatgaattattattattatatgatttttgtcatttaattatttttaatgaaaatttttctctctgatattaatattttcctttttctgacattagtgtagaaattttaacttctgtgggttgttttgtttacattcttgttaaactcttaccagtcctttttttatttttcagattttcacaatgagtaacagtgatatacccattctattttgaaataattttttttagttttatattttgcttgtcaaaactcaaagtttttacttttcttttctttttttttttttagagggagtttcactcttgttgcccaggttggagtgcaatggcacaatcttggctcactgcaacctccgcttcctgggttcaagcaattcttctgcctcagcctcctaatttgctgggattacagccatgcgccaccacaccaagttaattttgtgtttttagtagagacagggtttctccatgttggtcaggctggtctcaaactcccgacctcaggtgatccgcctaccttggcctcccaaagtgctgggattacaagggtgagccaccgcgcctggctgagttttcagttttctactagtgattttgccatttagatttgctttaataactgacatatgtcttaattcaattatgcaacttatgcacttttatgtatcatgctgtttctttaattttgctctgtgacttcctttcctgttatttttttctttctgttacttaaaatgtatggactcttttcttcatttaaggtatttttatatccatgtgtgtttaaattgtggtataactcatctttatttgactatcaatgccaagcctggaatagtatctattgattcccctgatgtgagatgaaattagcacattcacttcctgctgtcattgaaccaccagatttttgtgtggctacatttaaaataaatgagaaataaaaggaataaaaatactaattcaaatgtaatttgaaaaaatttcttgatgaggttgaggagaatggtccaatgcatggcatacaaaatcacttctataaatgccccacctgcatcttttttactcacataattatttttttgaagtgtagtcttgctctgttgcccaggctggagttcacaggcataatgtcagctcactgcaacctctgcctcccgggttcaagcaattctcccgcctcagcctcccaagtagctgagactacaggtgtgcgccaccaggccgggctcatttttgtatttttagtagagatggggttcatcatgttggccaggcaggtctcgaactcttgacctttggagatctgtctgcctcagcctcccaaagtgttgggattacagacatgaggcaccgcgcccggcctcctctcataattatattcactatgccaattgtgacttttctatctccttctctctcccaaataaagtagttcttctttttcctttatcatcccctctactctctttccctctcttttctctcttctctctcttcctctccccagctttttcccaatcaggcctgttcctcttttcctcctcaacatctggatcagcccctcccagttatttaatagggacatttttcctctctcaccttcctaagtctccactcaacaccacactcagcaaatcaaatcatttcagggaatcaactctctttagaagaatgggtataaatacttaaacttttttacctgtgacattcttgcatagtgagaaatcatcctatgaaaaagagaaacgatatctaatctgtgtcctctctaaccatcttgaagttcataactcaaacctcttgatttttcttctctcacagagttagtcttggctcaactttaaaacctctaagatgttttgttcagctattcttaattgtcttcactaaaacctaggaactgcatttgtagctgtcttgaaatatatacatcagtcttggttctcaaaggagatcaggctggtaagccagtcaccctttgcttcttccatgagcatgcagccccacctcctctatccactcccatatttcctaggaaaaacagccttggatacgtaccctgcaatttcattctctttctgtagggtctctccctcccactaaatgaaaaaggactatatacagggttgctttttgtttgttaacttttatttcccaaatggctataattcaccataatatgtatcttgcccctcttttgttacttgaaaaaaattacaaagtcatttcttcttcatgaatccctgggtacaggtttccatttatccatatagtcatgctggaagcaagttaagatgagcagtacctaaactgtgttgtgaatgggtactgaagaatatcactgggagtcaggacccatctaccatgatttctcatctctcccaatccacgcctcccagaaaattttgaatctttttcctacatcagaattgccaaattttgatcaagtttggatgcattgtaggcaatatgcaatagctcttacttcctctcaccgacttttgaatttttcttcctccaatttttgaataaataattaatatcattcaatcaactctactttcctgctaggataattttcctaattcatttgcatgctcatgcttctcttctgctcaaatagtattacattataaaatccaaactcctaaacatggcccaacctatctccagatcttaactcttacacttatttcttattggctatagtgcattctcatcacacaatgaggtcttgcattttcatgcttctgtgcatagtgtttccagttgaaatgctaccagtgcttgaaatgctatttatcaaacctataatttgaaatcttaccaatttcaaatgtcatatttatcatgagtctacattgctccccactgagaaataatcactcttgccctgttaatcccactctaaaacaatagtcctctattgtttttcattgtagttacaggcatatgattgactgttacattaattctcttcgtacctttttttgtattcatgttcttctacattgaccttaaacttggctttactactatttgaaaatgggacattagtaaatgtcctactaatgtatcttatcaagcagatgcttggtagattcttggtagtaggttcttgagcttttgcttttgagaaattttcttttggaatgcagctgttatacaaaaagaatgcccaggctatcctgctctaaaaagcatccatagggaaacactggaaagttgtacaacaattgtaataagagacttattagaggagaaatgaggtgctctggcttatagttatcaccactgtacagacacatgacagaagtgttttgaatatttcagcccagcttactcaacagctgcctagtacatgtggcaaaagaatgcatgaactaataaaaaaaaagtcattgttgtttaagtcactaaggtttcagatgagttgtcaggcagtgatagacaactcaaatagtatgtttctttgtttctgctgtattgaaaatattttaaatgaaattcagtgcatttttattttattgaacaacacttagcatattgcatttgataaattataccttaaataaatatttatctaagttagtatggactccttttatcttcattacaaaactgaaagatttgcatgacatattttatccctatttaaaaattatacaaataataatagctaacatttgcatagcaattcactatggttacaaaatcaatataaagaagactagctttggaactaataagctattatagcaaggttgtagaatacgtgactaatatataaaagtatattgcttccctatgtgccagcaataaataattgaaatttgaattaaaaatacaacaaagaggatttttaaaatggagatatattccatatttatggatagaaagattcaatattgtcaagaggtcagtttttctgaactcaatctatagattcaacacaatccaaatcaaaatcccagcaagttattttgtcaatattggcaaactgattctaaggtttatatggaatgtcaaattaaatagaaaagccaacacaatattgaagaagaataaaaatgtctaagggctacatctacctgacctaaagccttaatgtaaagctacagcaatcaaaacaatgaggtattggcaaaagaacagacaaataaatcaatggaagagagtagagagcccagaaatagatccacacaactgatcttcaacgaagatcagatgaaggagagataaaagttatcacagtgaaatttgctctaatagctaaaactcttgcttaacattctatttcctgtgaaaaccgattaaattatataagtctggcatgtatcaaatggtaatttcaaacattaaaattatgattttaagtggaggccatcaacctgagtttaaaaaattctttaataatttatgaatatttaatgtatcattttcatttccaattatttaaaattttatacataattccatctttccagtgtttgatactggttataagtaaatgaattttgtgattccagcatgatgccagtctccaaatcactgcctgttttgttcagttttgtacaatcacagcatgttgtttacagcagcactagaacttcaggtctgtggaaaacatagcaccaaatacgtaaagcaaaccattccaatacattaaataaactgctgacctgccaaaccctgagtggaatgagcctgacatagctgccatgaaaatagctagagctgtgtgccctttaaaaacagttgaaattgttcaacgttaagaaggaaaaaagcagaaatcattacaatgcaaacgcttattccaacttcaatataatctatcattaccaaacacacaaatagctgagctaactaatattttgtgtatgtagagggataggtggcctttcaaaaatacaaggaattgatcacttactgtagaatatcaaagtaggtgagatagaggataaaaataaatcaatgttgttaaacctgtttccttagcaactaaccaattgagacaaaaagaaaagttttttttttttcttgtatgttctgaattacatgcagctacataatttgcttattatggactttatatagactcctatgatgtagggtattttcccctctaacctcaatgtccaaaagtcatgagattttatcaacatgtaaaggtcatttaaacacaaatgttttttctttcgttatttagaacaagactataagaaacataaacaaaatcagagaattttcaatattatatttaaatatctggaatgtctttgcattatttattgtatagaattacattaatataagaaatttcatggtgagggtatttggaattgcatttacataagaaatgtgatggggagataatttcacaataaagaaaacaaaaatatcttaaaccataaagtgtactcttcctttggcattcttttgaggagaaggccttctgatatttgacccctattgctagaattctcagttttcataaaagggtgctgaccctactgaaacatcagctatggtatatgcctgtgaattcaactgcccttcatagaatagctacacatataattctgttgttataactcttccacatattattatatctgcccttctatcaagttaaaacaatagagcgatgcatagctaaactatttaatttcacctcctccatattatttttactgaattgtactctggtgtgatagcatcagtatatatattggggattattaaaacaaccctgaaacgttatcaaggtattgtccaaaaagttgtgggaaacatatttattatctacttcttcaggtttcatggcaagatgattccctggataagcttagtagcaaaataattacacataatcccaagaaattgtttccattgtttttttaatatactgtgatttagttagtagtcagactttcttattctcatgcttgactagtcatcttatgaccaaatcttctcatagtaagtatagaggttactataatgtgggattttggcttgttcctcactaagctattgtccccactcttattctactttctctttcatctcaccttaaattacgaattatgacattaattggcagcactagttccagtaagagtaaaaaatagacttcaaaaaaatctcaaatacacagaagtttatcttatgttgacatgaacaatgttggacaagtgtttcaggtagactcagccttcctccttgtagacattacataatacaactaacaaagactttgccatcttcaacatgtgattttctttttttttgtttcttttgtgttttttaatttttttattttattttatttttattatactttaagttttagggtacatgtgcacaacgtgcaggtttgttacatacgtatacatgtgccatgttggtgtgctgcacccattaactcttcatttaatattaggtatatctcctaatgctatccctcccccgtccccccaccccacaacaggccccggtgtgtgaggttctccttcctgtgtccatgtgttctcattgttcagttcccacctatgagtgagaacatgaagtgtttggttttttgtccttgcaatagtttgctgagaatgatggtttccagcttcctccatgtccctacaaaggacatgaactcatccttttttatggctgcatagtattccacggtgtatatgtgccacattttcttaatccagtctatcatagttggacatttgggttgcttccaagtctttgctattgtgaatagtgccacaataaacatacgtgtgcatgtgtgtttatagcagcacaacgtgtgattttcaatgtaacagaagctatctttatctgattcaataggaagagagaaaaaccatgaagaagtatacacaaaagtgttttgtgaatcaggcctggaaggaacactgactgcttttgttcccattgcttagctaaaactcagtggcatggccacacctgactgcatgggtagctggaatatgtactataattatgagccccaagcaaatattaatttgttgagcagctagcaccacctgctacagacatatattgtcaactgcaaacccttactagacaggtagagtaagactgagtaaaggtattaaagactgttttttgcaacatttataaaatatgtgtgtatattcagattaagttaatgtgtcttcattttggaagagaaaacataatcaaaattgaattgaagttattgcagagtgttgttgactctgttgattcatatatacagattgttactggaggtttaattagcataacactttattagcaatgccatcctgttacattgaattttataacattttagagaatgagtccaatgagaaacaaaacttttttacatggtgtcaacagaaagacacacaggaatcatagattccattatatacacaaactacagacatgccataacaacttcatgagtagtgcattcagattcttacacataagccttctaatgatgaaaatcaatatctagttattaatagatttttatatatgtagaaacactttcaaataggtttagcagtgactttgtatgaacttcagatactcattcattttcttattcattggttccttctcaggtaaacaaagataataccagagaaaagcaatctgacacatagtgaaattattaactgtccagcaattgtttctagcaaattgttatttccttaaaaatatggttaaagcacctgttctctagagtgtgaattataaaacatcagagaaaccataaaatacattattgtgggtaatatcaaacaaatagcccaacctcatatatatgactgtgaatatctatgtgaatctgaatagatatatccacaagcaggattcttcattttaattattgagctaagaatatgagaaaattcagttgtatacatattaatactgagtcgtgcagaaatactcaatattgtatccaggcaattttcatttcaaaggagtccatagcccttcttccctccaagctccatcagtgtcagggctgaatccctccacctccgtaactcaaacagctctacttaaaagtatttataatactattatagaaggcatttaccatcagtaattacctaaatatctctctgattgtggtagtcattagggttcatctctaaaaatgtttagcacacagtaggcttgcaactctggtctcctcctggctgaatgacagcatgggatttattctggtcaatgagttgaaggtagaagtaataaacaccaccccaggctgagcacttagccaccagtagaaaagccaccagaggtcgctcttatttccagcataattggcggtggtgaagatgggttctcaaattacaaggataagtagaactcattatgccacccctacctaggatgaatatagcatgaggaagaaataagcctttgttgttttaagtcacttatattttggagattgtttgttacagcaacatcacttagacttataagctgaaattttatttctgtgttgttgaaagtatttttttttcaccttgagtaagcgtttcactggagcttattttaactatcctttcagcttttctaccaaaactgagaatagcatggattgaaaactgtccaaggaacattcagtttgttttgttgtttattttgtcagtgaaattgagcaaagtatgggaaagtaagaaaaattgcagttgaacaattagtggcctaattagagaattaggcccaattttgaatcacacaggtagctcccaggaattgtaccatttgaaaagatgagtctaaagaatagtattttactaaaattttctttttcaagattttattaaaattcaaaattttaaggaatatttacaggaagtataaccatggaaaaatgagacaagaatttatgtaagtgtaattgcatgctaaatatcagacaactcatccaccaactcacttagtaatcatcttccaagcactacgttccttcaagaaatattgattgaacatttcaatgctatggtcgaactttttgcttcgtttgtatttcctgagagttgtatactctgtttccaccttagcttcagtttctccatctataaaatgcagataatagtcaatactccaacaaaattggagtatttcataaaatgtctttgttctcatagctactaaccatccagactttatactttttagcttgttaacttgtatagtatttgtctataaaaatattatttgtctttagcacttttctttagacttttgtgaacatgagctagggtgtatgagacagtatgtcctcagaagatttttaataaatacattaacgttagatgaaatgagagtgtatgcatttgtactttcctctcagttgcagtcataaaatacccctaagatgcaaagttaagtcatcatattctagagaatgggtttaattaatcaatatttaagtgatcttagaaaataccaaaaaatttaaaatgcttcttaatatgtataaggcctttaaatactgacaaatgtttatgttttatgccatttcctaatgagacgataaagccatatttaaaacctgttattgaaggtaaatcaacttgcaacctactatgagttagtcaagctggcttcataagaataaaatgtgcaaagaaacacagagatgaactggacacagtggctcacacctgtagtcccagcttcttagaggctgaagtgggagaatggcttgagcccaagagttcgagtccatccttgacaacacagtgaaccccagtctcaaaaaacaaacaaacaaacaaacaaaaagaaatacagagatgacagaaaagcagggtcttgggcaggaaggaccacagacttgctagttaaactgaactatgctcaagcagagaaacaaagggagagagaagaagagggaagagactgccatacatatggccaaagatatacaagagattatgcagacttagagaaactgagtaagcaatatccattttgaatttacagttccagttagagttaggatgctgatttattgacccccagtttcaagttttcaggttcttccgaaatttttgtcatttaaccatcctgaagcagtatctattttccagcaaatgatacaacctcattagaggcagttaaggcacatgaaactataatagccaattgtaagtatacagtctaaaatgaaaaggaactcttttttgttgaaaaagtactttaagtggtacttaaaatctggttaaagaaataaaagaactgctgaatttgtcaaagtggaaagagaagtctatggtgaaatgacctgctataggtttaccatggtgtagtcaacaagtacttaacctgcagttgctcttaaataacaaagttatatcaatctcatttatattttgttattttattacagaatagggaaaaataagaaaaaacactggaagataattattgtataatatattctcagggtttggttttaaaaacacacacacacacaactgtatatatacgcacaaacacatataacatttagtctttttgtctgtcgaaaggcagtcatccctggattccctctacagagtcatttgcctcctgagcacaggaaactgacatgccataaagaaaggtaatatctccttttatttttccttaagccatttactcagcacactttaagggtataacactacagtcatttgtccctttgatagtggaaccatgtgctcccattcagatggtataaagttttggatttagcagtgaataaagcttccgcataatgactgtttttccaaacccaatgctattgacttctctgatctccccaaggaattatttctttcctggatgatgcataagaagttgattgcacaactcaaagatgttcactactttgtccaagtatcacaacttctgttgtatcttattttcttttctaagtagtaaatgcttagagagaaaatattacatgtgtattgtttttggatttcttaaagttccttgtagaatatctgaaatatcagaaaatgttaaataaattaattaataagtgactgacactaggatgtatgtgcctggatttccactcttctaattggtgtgattgacctaaaatcgaattaaaatattacacatgtctatacatagtaaaacaatattgactttacgttatgtgttgaatgttgttcccccaaaatttatgaattcaagttctaatacccagtgcctcagattattgccatatctgctgtaaggtctttaaagagctgattaagtaaaatgaggctattagggtaagccctagtctaatcttacttgtttcttcataagaggaaatttggacagagacaccaaggatgtttgctcacagaaaaaaaggcctgtgaggccacagcaggaaggggcccatctgcaagcagagagctgaggcccatctgcctcagcagaaaccagacctgctgacaacttatcctggactcctaacctccagaactcagggaaaataatttctcttgtttaagccaccacttcgtggtattttgttgtaacagtcctagtaagctcctataatttaagaagagaacaaaccatgcaagttataaactgctctgaaaggttttattctatatggtattaggaatatgtgttctgtaatactgaataaacaaacatgtaaaagaaaaactaacataaatttagtcactgtatatatataaatgagaaatattccaaaaccataaaataaattagaattatttttaatataaggttatggcaaatacattgtatataatgaaacatctaattataataaataatatataatataatatgtaatcaaacatctaaacataataagtaaatctaataaattatatatgtagtcaaacatctaattatatatataattgaacatattaatcaagtaaaatatgatattttacttgccagatctaggcctgcttagacttaaagattaaaaatatatataacttgtattttggctctagaatatctaaaagttatataagttttcatttgcaagcctttctatgtcaaaatgatcctgtgatcaaaaggcaacaattttctggctgaaaaactgcatgcctgtgggcctgtctagactacagtaatgggctcccagttggcttaaacatgttctctgaaaaatgggatatataaaaatataaagactacaaattgaagatcaaaaagcctcacacaatctcagaaaaataaaatttaagtatgtagttactttgtttttctttaggtatcccaatatgccaactatataaatggaagttaattagtcagtgttctccatagaaacaaaaccaataggggatagatgatagatgatagatagatagatagatagatagatagatagatagatagatagacagatagatagataggtaaataggaaaactttatgttatttgaagtgcatgtagggaataataatgatgagaattatatgatgtttaatagaaagatgttatatttggtgataaggaggcatgtgctatagtttggatattattcctcactcaagtctcaggttgaatgctcattcccagtgctggaagtgaggcctggtgggaggtgtttggatgatgggcacagatccctcatggcttggttctgcctttgcaacagtgcatgagatcttgcaagatctggtaatttaaaagcgtgtggcatctcccccaccaccttccttttttccctcccattctcactgtgtaagatgcctgctcccccttcaccttctgctgtgactgtaagcttcctaaggcctccccagaaggcaagcagatggcagcatcatgctttctgtaaagcctgcagaaccatgagctaagtaaacctcttttctttgtaaattgctggatttaggtatttctttacagcagtgcaagaacagcctcataaaccatgtaatttttttctttatatgaaaataaaccgtctcaaatctgctatctgtaacctggagacccatggagaccagtggtatagttcagtttgagtctgaagacctgagagctaggggactcgaatgtgtgagtcacagtctgagagcaggaaaaaaccaatgtttcagctaaaacaggcagaaaaagaggtgaactctcctgtcctctgtcttttatctattcatacccttaatggattcactgacgcacacccatgctgggaggggccttgtgctttacacagtccactgatccaaagctaatctcatccagaaatatcctcactgacacaccctgaaataatgtttagctaaatatctgggcatcgctgacacctaaagttaaccatcacgggaaatcttgtaattttaattaaataataattaaaagcattgtttagtactcataatgaggatttggtaagatggctcattcaaattatttcaacaaaacattttctattaaggaggctattgaagaaatgtgatctggaataacgattataatacatttacttttatggatgattgcattgcaagagggctttgtttgccaacaattatacaaaatacattaaacaaattacacgtgccttttctttaggcaaaaatgcttttagtttatttcagcttagataattagatatatcattttataggctcttaaagttagttatacagactcttatgttgattctagagttagaaagttttaattgtctggccaggcgtggtggctcatacctgtaaccccagcactttgggaggccgaggcgggtggattacgaggtcaggggttcgagaccagcctgaccaacatggtgaaaccccgtctctactaaaaatacaaaaattagctgggcgtggtggcaggcacctgtaatcccagctactcaggaggctgaggcaggagaattgcttgaacccgggaggcggaggatgcagtcagccaagatcgcaccgctacactccagcctaggcgacagagcgagactctgtctcaataaataaataaataaataaataaataaataaaaggaaagttttaattgtaactcctcactgaatttataagtttagaaatgaccatgtgtcatattttaatatctggcctagactatccaataggcaatacattctaaatatacagtatttttgtaaaattgatctactgccctaaggtatgttttccaaaggagtttttttatgtggaattcatagtcagtaccttcaaatctaaataacaacagctgtccaggtgtggtggctcacacctgtaatcgccagcaacttgggaggctgaagcaagaggatcacttgaggacaagagtttgaggccagcctgagaagcatagcaaaatctcatttctacaaaaaagaaaattacacaggcatggtggcatgtgcctacagtcccagctactcatgaggctgaggtgggaagatcacctgagcccaggagtttgagactgcagtgaggtgtgatcataccactgcactccagcctgggcaacagagtgagatcctgtctctaagtaaataatgaataaataaatgaataaatacctactgctgtgtttagagtatgcccccaaagttgatgtgttggaaacttgccattttaacactattaaggggtggggccttcaagaaatgatgaggccggcagggctctgcagtcatcacaggagtgggcccctgctaaaaggatgagcttggccccatttcctttctttctagtgattgctttcctttctgccttgttatgatgcagtaagaaggccctagccggatgctgagcaggtgccagcactatgtccttggactttccagccttcaggactgtaagaaataaatatcttttcttcataaattactcagtctctggcaatctgttatcgcagcagaaaatggactaagatacttacctttatgcacacatcatgctaatttaagcctataacacgatcgctttgttagtcatccataaactgcctgccagatattttaattgtcttctattgaacatgtttccagaacctcaagacttttgccactagccctctcaaatagccaacctaagcctgtttcttcaaatagctaatttggcattatggtggcacaactggcagattggtacttccataagctttctgtccccagtaataaatctagaacagccctcagtaagatggcctcacaagtattttcctttctcagcactgactgattttgcaatcaataaatattctatcaatcagctgggcacagtggctcacacttgtaatcccagcaccttgggaggctaaggtgggtggatcaattgaggtcaggattttgagaccagcctgagcaacatgctgaaaccccatctctacaaaaaatacacgaaaattagccaggcatggtggtgtgcgcctgtagtcccagctactggggaggctgaggtggaaggatggcttgtacccaggaggtcaaggctgcagtgagccatgattgtgccactgcactccagcctgagcaacagagcaagaccttgtctcaaaaacaaaaacaaaacaaacaaacaaaaactctatcatcacctgtaagaaaaagaaaaagatgagttttacctctgatataaggcatgaggagatctgcagacctgctcccagcaaaactcccaagtaaaaattattacaaaaaaacttttacaaaatttgttacaaataacaaccattttttctccagaaatggcccaaagtgaataaagcaaataaaaatgaaataaataaaacattttatttaatctcctgaaactcagaaagaactatgaagactatgatattttatctatggtttcttcatatcttaatatttgttatttaagagtatattgttttaattttcatgtatttatgtattttccaattttccttccattatatagttctagtttaatttcattgtgatccgagaacatatgtatcatttaatccatatatatatatatagtagcttgttatggcctaacatgtaattatcctggagaatgttccctgcatgcttgagaaaaatatgtattctactactgttgtgtggagtgatatatatacacacacatgcacacactggtatatatatatatcattatcaaaataaagtattgcagtctctattattatttaattttgtctttttcctttaactctgtccatttttgcttcatgtattttggacctctatttttagattgatgtatgttaatagttgttatagtctcttgatggattgatttctttatgttaaaaattcccctttattgttattaaatgttttgattaaaatctatttttgtgtgtgtgatattagtatagtcattccagcactccttcctggcatggaaacttgccccagtgagcaagctggagttggagcaattggggcagactctttacagtttactgtgcctgtggtggaggttttgccctaaactaaaggatgggtggagaactggtcccctctgcttcacctatctataatacagcttctataacatggggctcagggggtgagaaatagttttgctagacccctgctccccagttgaaaaacatgcccccaggctgggagctgagggaaaaggcaacccctgtcttctccgctgatgtgatgtttaattttaagtgtcaacctgactggattcagggatacctagagaactggtaaagcgttactcctgggtgtgtttttgagcgtgtttcccaaggagattggcacacgaattgtgaactgagtggggaagatccaccctttatgtaggtgggtgctatccaataaactggagacccagatgcaacaaaacaggccagaaatggatttcttcttcctcttctggtgccggaattctctcctcctcctgcccttgaacatcaggctctctggtcttaggactacaggacttaggtcagcaactcctagattctcagacctttggccttggactgagaattataccatcagctacactggttctgaggctgttatatttggaactgagccaccgtcctggtaccccaggatgtccaacttgccaatggcctgttgtgggatttctcagcctctataattatgtaagccaattccccaataaatcccttctaacttctctttcttcttcttctcctcctccatatatacgtatgtgtatatgtgtgtgtgtgtgtgtgtgtgtgtgtgcgtaactggttctggatatacagaaacaatagatctacagaaacaatagatccagaaccaataggatatacatacagatatcctatgggttctgtctctctgagcatcctgacatgcccaaagtaaagagtccagtgtagagcttctacaacccagagctggagtagagccgagggtggtaagagaagaagatattgtttgaataacatagattctcactgttctaattgagatttagtgggttttactgaataaattacttcccatctgctgtgtgccctaggataattaccaaatattttaattgctttcaaaaaaatgtttttaatcaccttaattggtggttgctagaccatgcctctgacaagttcctttctctgccactcagaaagtattgcccctttctattaattcttatttatttttaaacatgctacatatcataacaatcatatatttgtaggaaacattttccaaatttctgttagaattgtaattttactgtccatttaaaaaatatattctttgctcagttgttcatattttagattgaatgacaaattaaatatacataacaatattatttttattgttactattaatattattattattttgctgattattggctttaatgaaaatcaagttcttcatattctctgagaatccttattctttgcatcctcatctcgaaggatttattatgtatgcatgttgatgtatatgtatatagtggcaggggctgaaagtgtgtcctatgcttatttctatgtggtagaactgaattaaatccttatatcattttagttaatttttgcaattatcatacgagatagagattattgttcacacttataatattggtgattaaatgaaaacatacatctgaaaggttcttccttggtgccttactaaacattaattttctcactatttttttaaattaagtttttttattgtcttctaacttataataggttattactatttaactttttcaatcgtattttcaagttcattagttttattttttatttcgaagatatttataacaatactgaacacataataaagaccaaataattatgtgtttaagagaataaaaatatacacaattatgttcgaatagagagtaattccaaaacctgatatttgtatgttattcctctccacctttttgctgcttctcatcttcttttccttgaagaaacagttgatctaaattctgcacactcttcgatggcctaaataaatttatcgcccatacctgatttctactaaatagttccatatgcacttatctcttccctctccaaagttctgtccttaatgaattgttacatttaatttgtctgctttatctcactgattttattttaaatcttgaaggtattacttatatctgctacttccttttacccttccatcactcctatgacagtgctgaatacacaatacagagttcatttattttcccttccttgctgtttcccttaggatgaaagaatagttagtgtaggaaaaatcactattttgctttgaaagaatagttagtgtaggaaaaatcattattttgctttcagacaagaaattgtgacacagcaaatttaagctgttcggctatattgagttaatcccagatattagtacgagatgtttataaaagtatgagggaaatgcataattttttaaaaataaaattgatcctaaagtaaaatttaagttagcaaaagaaaatgatgtgctaaatagagtgaagaactgaagacaatatctaaaatgactagaactgacttaaaaatctgttggcgaaatatggctgacaaaagtagtatataaaagggataaaatttttaaaataccaatttttaaaaactactagttttgtcttttggtatggattgctaaattcaaatacaatgacctctgtgcttttggtatggattgctaaattcaaatacaatgacctctgtgcaagaccttccttcatttcttcttctacagcttcctcatttcttagtactaactctaagataatttatcacacttcatagttaatctgatcctagcttttgcaaccctattgatctagaaagtagatttgactgacctggctgggcaaaaaattcacatttcactattaaactctacttagaccttcagaagttgcaaatacgtacctacccagatagagatgggaactatatccaaatagctacatcaacattagagaatctccattagtatttatgcttttattatttatgtggatgtcagctccccacaagatggtaaatttcttgagtatggggtcatgtttatttatatctgtgtgttcagtatatcacatagtttcataacatgttttctgtagaagcacaggttcttaagtaagtcatacttaagttaaaactgtaattctgcttgctggtcatattactttgagctatctaattaaccctcttttgccttaaaattcattctgaataaatgagcaaaataaaaacatctattttcttggcttactgtgaggattaaaagtggtcatacatacaaaacactgatacatcatgaaatccaacaaaagtcagtgactaatactattgttatttttttgttgctgaaatacaatagagaaatagacaattgtacttagtaagaaaattattacatgattttaataattactagttaaaaataaataaaatacagaagtaatgtcagcaagatggccgaataggatgtccccagttcacatctcccttgacaaacaacaatctggcagccgtccatgcatgaaagtgtctttgtgagagctttgagatcctagtaagaggttgtgaaaccctagtcaagcccaagagtgaggagagccattttgagaaggcagggatccactgctaagattgttcaacatggtcccagctgcagactgaaagcaaccccatctctgtatagtcttggaccctgcctcatttggaacggttctgtgagaagccccatatgccatacctgttcatgcccctggtagcaagccaaccaaccttgaacctgatggcagatcctaaagtagccctgtgacccagcaccagccctactctaccatggaagagaatcagtcctgcaaatcaggggcccagcaatcctagtctgtggccccagaaccaggcctgttaaccttggtcctgactatggactctgaagccgccctatgacttggttccagccatgcttcactggggtccaaatacagtcttgctcaaccatggaaccaagagaaaacatgcctgttagaatcagtgctaagaggccccaccagccttaaacccaacggcagactctgaagcagccctgtgacccagttccagcttctctaacatggttccaggggaagttctgcttacccacagacttgcccagggagggacctagtgggaccttcttagggatccagcaggagtcacatccatctctgcccctaacactgagcccaccatctgtaaacttggctgcagacctggaagagacctcatgacatggcacaagtcctgctccactgtgttcctggaagcaattcaattctccaggtgatccagtaggaaccatgctaacctgagcccttgtaaaaggcctggcaacagtggacctcgctacagccacattacttggctccagtaccactctactgcaatccagaggcagtcccatatatccagggacccaggaggataaggctgaatccagtctgtacagacaggaagagatgtttgctcctttaattgcaaacacatcaacacaaagctacagagatcatgaagaattaaacacaaaaacaaaaaacaaacaaaaaaccccaaagaaccaccaaaggaaactaataaaactctagtaatgacccacaaaaataaaaatctatgtatttcctgatgaaaaacttcaaataattatttaaggaagctcagtgagctacaagaaaacacatattgacaactcaggaaaacaacacatgaacaaaataagaagttcagtaaaagatagtaatcatttaaaggaactgaatagaaaatacagagttgaagaaaacaatgaacagaatgaaaaatgtaatagagagcttcaacagcagactcagtccttcagatgaaagaacctgtaaagttgaagacagatcaaatgaaatccagtcagagaagacaaaaaaatagtgaaaaaggtctatggaaattgtgagacatgccaagtgagcaaatatacacattatggaagtttgagaaggagaagaaagagagcagaaaactatataaagacatagtgcctcaaaatatctcaaatattgggagggattcagacattaagatccatgaagctctgttgatcctaaacactgatcataattattgatcataatcaatcattgttgatcaaaatcactggggaaaaactgaaaacttttcttctaatatgcagtacagggcaaagatgcccactctcataagttctgttcaacatagtactggaagtcctagcaggagtaattagatacgaagaaaaatgaaagaaatccaaatcagaaaggaaaaagtgaaatgatctcgtcttgaatatgacatgattaaatatgtaggaagccataacaacttagcaaaaaacttaaagctagtaaaatatccattaaaatttcaggatacagaatcaacattctaaaatcagtggcttttctatacacaaacaataaattaccaaaaatgatattaagaaagcaatttcattcaaaatagcaatgaaaggagctaaatatttaggaataaacttaaccaaagtcatgaaagacttcatcactgaaaattgtaaaaccttatcagataaaattaatgaagacctagataaatggaaagatactccatgttcatggattggaagaattaatattgttaactattccatgcaactcataaagatctacagattcaattcagtctctgtcaaaattctgacagcattctttacagaattttttttaattttgaaattcatatggaatcacaatacacctggaatagccaaacaattctgagaaagaagaacaaaactgaaaatatcattgttcctgatttcaaaatataatacaaactatagtaaccgaaacattatggcaaaggcataaaaacagacacacaatataggataacaacaaaaaagagcatagaaataaacccacacgtctacaatctactgattttcagcaaagttcccaagaacacataataaggaaagaatagtctcttcaataaatgtgattgaacaacttgatatctacatgcagaagaaaaatttgggtgcatattttataccatacacaaaaaccaactcaaagtagattaaagacctaaatgtaagccctggaagtaatgaattccaaagagaaaacaggggaaaagtttcttgacattggtttgggcaatatttttttttggtatcccaccaaaagcacaggcaacaaaagcaaaaaagagaaaattacatcaaactaaaaggattcttcacacaacaaaggaaacagtcaacagagtaaaaaggcaacctacagattcagaaaaatatttgtaaagcatataaccactaagggattaatatccaaaatacataaatacccaaacaactcaaaagaaaacaacaacaataacaaaatgcttctccccggccccaacaacaacaacaacaaaatcaaaataatttaaaaatgttctaaggatctgtacatgcattactttgctcaaataagacataaaaatggccaacaagtttatgaaaaggtgctcaaaatcatgaaccatcagggaaatgccaaccaaaaccataatgaattatcacctcatgcctattacaataagtgttatcaaaaagacaaaaggtaagtgttggccagaatgtggagaaaagtaaactcatgtacactgatgctgggaatataaattggtacaaccattatagaaaagtttagaagcttttctatcaaaaaatcaaaatagaactaccaaatggtccagaagtcccagttctaggtacatatctaaaggaaatgaaatcagaatcttaaagagatacctgtacaccatgatctttgtgccattattcataacagacaagatatgaaaacaatctaagtgtctgtaaatggtgaataggttaaaaaatatgtaaagaaaatgtaacacacacacacacacacacacacacacacaatgggatattatccagcattaaaaacagaagaaaatcctgccatttgaagcaacatggatgaccctgtagagagttgtgctaagtgaaataagccaggcacagaaaaacaaataatatgtgatttcacttacatgtggaatatttcaaagtctgattcttaaaagcagagggtagaatgatggttggtagggtttgtgaatatgtattggtgaaggatagaaagttcagctatgcaggaaaaataagttacagagatctaatgtacagcatggtgactacagttaataaaactgtgttgtttacttaaaatttgctaagggagttgatgctgttttcattatacaaattgtaactaagcgaggtgatggatatgttatcacaatctattcatttatcaaaatatcatattgtacaccttcaataatttttatttgtctattagctgtctcaataaattgagaaaaaataaattatttgaaatataatttcctttttagattcaaagctttattggtttaataaatgtttcatgaactcctatgaaaactgaaattaagcaaactagttagaaaaaattaaagtaagtattcatcatgatcgataatgaagcttaaacaatggcattttattagcatgagaaaattgtttctaatgggtataacagattaacataaatcacaaagtaaaatcaggggataactttttttgactgacaaagggaattagaattgttattttattagtgttgtgatagattgttagcatctctgagaaataatttctcccaaaacctcagttccatgttctttctgagttgacatcgcataaaaagttcgaaggtattctttaggcattttgttatttacttaaaatgttgctgagcatttagtcaccaatgcacatacttctttgcttcaaacctggaaacatacacaaaataaaactaaaaaccattaaccttagaaaaatgtaacttcaatgaagtaagtagttactgaaaccagaataggtttatcaactgtgttttaactggaacattaatgatatttcaaactctctcttctatttcaattcaaaagcactgacatgaacagcatttgcccttgatgtggttagacctatttggggcatcactggaaatatctgattgccccagtgagcagtaacataatatcacagtttggttcatcttataggcctagcctgatgcaccagccaactaggcagcaatctgcattagttattttctaggggaaagatatagtatgagatctactcttctaacaaatttataagtggacaaggcagtatttttaaactataggcataagtttccatagcagatctctagaacttaatcatcttgcataactgaaaatccatacccattgagtagcaacttcctgttaccttctccccaccattccctggaaaacacctttctctctgttctatgggtttgactattttagatgcttcttttaggtagaataatgcagtatttgtccttctgaactgacttatttcactgatcatactgtcctccagattcatccatgtcgtgtatggcaggaatttttcttttttaagtcaacatatgttccattgtatatgtgtaccaattttctttattcatttaccggctgatggacctgtaggtagttttcacatcttggctattgtggataatgctgcaatggacatgggagtgcagaaatctttcggattctgatttctttatttttcttttttttggatatacatatatacataccctaatgctggattgctggattatacggtagttctatttttaatttttcgaagaacttccttactgtcttccatggtggatgcaccattttacattgccactaacagtgtacaagtgttccaattcctccacatcattgccaacacttatctctctcttttattttttaaatcactcccacgctaacagatgtgaggtgatatctcacagttttgttttgcatttccctcgtgattagtggtgttcagcatctttttttttttttttttttttttttttgagatggagtcttgctctgttgtccaggctggagtgcaggggcataatcttggctcactgcaacctctgcctcccaggttcaagcaattttcttgcctcagcctcctgattagctgaaattacaggtgcacgccaccatacccagctaatttttcaatttttagtagagagggggtttcaccatgatggccaggatggtcttgatctcctcacctcatgatctacccgcctcagcctcccaaagtgctgggattacaggcgtgaaccaccgtgtctggccaagcatctttactttttttttttttttgggacagagtctcactctgtcgcccagactggagtgcagtggcgcgatctcggctcactgcaagctctgcctccgggcttcacgccattctcctgcctcagcctcccgagtagctgggagtacaggcgcccgccaccacgccgggctaattttttgtatttttagtagcgacggggtttcaccgtgttagccagtaccaagcatctttttgtatctctacatctcatttgtctttcttctagagatttctactcaagtctttggcacatttttaaattagttattgtttttcttttctgttgagttgtaggagttcctcatatattaggggtattttttttacatgctttgcaaatattttctcccattcattcattttagttaattttaatttaaatagctacatgtgtctagtgactcccttatagcacagaacagctttagagtattgaactggtgaattggtaataaaatacatgggttttagaggcagactgtctgaattcaaatctctacttctttatttactagttttgtgactcttctgtgcctcagtgtcctattctgtaaaaggggataacaatactattcaccttattagctgttttaaagactaaatgcattcatatataaaaaagcacttaacaaagtgtatgtgtttattaggagggtaatggtcaagcgtcctgggttctttgggagtgaggagaaaagagagggacaaggtattatggaggccacccagtaaggagcactaggcactttgtggtttcatcctagaactgacctttcaatcgctgaagctgttacattattttgcttatgagttcaaagagttctatacaacagtcactgagaataacaactgggacatagttttccacaactaaagttatactggatagatacattgccacacaaaggaaaacctagtttttaaaaaatcacagaagctaaatttgtcatcatatgacttgtgagatattttattgctaggctgcctatacgatacattgccaaaagagaatgataacagtaactgttagaaacttacttgaaacaataagaaaatgtgcaaaagaaaagaattctgtgttggctaaatgaacacaatctcaagggtaaattcaaccctatgtgacagcaagcttgaaaatccctaaccaaatcagctcctcctctcagtctggtattgtcctggagaataaactgcttttggttggaaattcagttgtgttgacatgagtcttattttaatatttgaatagccttcagaggacaggagaacctttaagtcatttgtcttctgctgtgaatcagttgatgagacttttttttcccctcagcccccaccagagactaaaccactaagaagatggaaattttgtagggaccagagaagagattcaagcataatttgaatgcagggtctcttttaagggagtgaaaacactttaacacttttaatattttgtgttggtgttgggcatctaagataaggggagaaaggtgattttcaaaatggtcaaacccacttagaaatgaagcatcatattcagaaaacagccaaatgagacagtggtgctttggtaaagcaaattaaagagtgaaagtgaagtacaagctccatgaaatattaaaataataggctattataatgtagtgcaattcctcttatcactccttatttttcactagacaaaattccaggtactccttacaggattattcgattgctatacttctgtttagccttccctcttaagctccccaaatggcatctcacaaaccaaaccaatctctctccttcgtgtttctatgcaccattgcacatactttgcccgaggtattcaccaatttgaatttagttcagaggctcctgaatgttctcaattcatggaaactttcatgcctcataattattttcatagcacccctggaccaaaagaaatgcctgatagttgtgcttattaagtaattagatccaaatcacttaagtatctatgccctgataacatagtaaccaaaacaatgacataaatggaaagaaaaagtagtattttaatttaacttttaaacaacaaaattacttttgaatggcatgtgtttgcctattgggcactgtacaacttctcaaatattagaatcagattgaacaatgccaccttccttttctgttccatattgatttcctatgcagttcttgatttttatcacagcacactgtgaagacccaactgagcaaggtctcacatcaatgaaaggaatatagcaggatatcatatagaaattgtgaagcaccttgagtgagtagtttgagcagtattcaacaaatattgaacatctgtcttttccttgaagttttacaatacatcatgtatcccttatgacttcactggggagcactaggatgcctcatcacacaggtcgtgaatcaccacttcaggtatttttaaaaatgtataccattccccctagagtatgagcatcttgaggacagaaattgtgtcttatttgcagctggcatttgaaacttgtcacactgtgaattatctaaactgctaaatcaatacatgatttcagatgagtaaaaactagaatgttttttagtttgtattgctacaggggatggtccatcataacttaactattgcctatcaccaatgaggcagagcatattgtcattgatttggtgtacaacaaaaagccggaaaatgacacaatctgaaaatgggcaactcaacagaaggtttccaaatgactggctggagaggaaacagtgggcactggaaacagaatggccccttcctatagagtttggcccagacagaaagagtaccttttctgacactgtaaggattgtgtacccagtggcagaaaagatctcaaagtaagaccagatgtgtttcacagagcgatatcctccctctgaatgctgaaggagacgtggctggaatcttttattctaggggcccaggtggacccttgccagtaagtttcttgctagttactatgagacttctggtgaattagcttcatagtttatcacttttcatctagatcttacattactaatgttttaaacagcattttctaaattattttctgaagaatgttactgtgttccagaagatgttaataagatgccatgaaacctaggtcgtagctatacatatctgagaaccacagcatgcccaaattcaactcttagacataagcaataaataccagcctattaaaagctctgagaagtcctgaattaattcaactttcaactttattcaggacttctcagagatttaaatatgtattattatatgttaaaatatatggtttaatatatagacaaaaataataaatattactagtataataaatatacattactgagtgcataatagatgctgggttggcaaatatttttttctataaagggtcagagagtaaagattttaggctttgtcagtctcatacggtctctttcatgtgtcttagttttgtttacttgtttgatttacaacaacctaaaattttaaaaaacattcttaactctcaacctcaaaacagttcaagaaatagaaaattcagcatcaagcaacataattttctactcacatggaacttatattcttacattacattcctactcacattcctacatttttgggagagaaagaaatcaaagaaagaatttgagttaaagtgagaaacattcagatctttctttcactggaatatttagactctagtgtagaaatagtaataggcctaatatcaatactgttgtttctccaacggagaggcccgaggctagggagagaaaagaggaagtggccagccaatgaagcaatcaataaaaacatttttcaattaagtttaccatcttacgtgggcacagttcttggtgcccccaattacactggtaacagcaaagatcatcactgatcacagaccatgtaacagatatgacaataatgaaaaagtttcaaatactatgagaactaccaaaatgtgacagtgagaaacaaagtgagcacatactgttggcaaggcggctctgaagacttgctcaacgcagggttgctaggaaggttcaacttgtaaaaaatccaacgcctgaaaatttcaattacacaaaacgcaataaaatgaggtatgcctctatgagtattataaaatatacatacaagtgctattttaaaaatctgttaaggaaacaaaagtgaaaggatgttgtttcacatatgtattatcagggatggggtttctgagaactgaacttgtgtggtaccctgaatgaagcgaaggcttgagccatacaaatttctaggagaaggaaaagaatagtcctaaggtcttcagtgctaaaggactaaaaaggggccatggtcactaaatagggtttgatagtaaaaaaaaaaaaaaaaaaaaaaaaaaatggccagagagataatcagaggtaaatcaagtctggctttgcagaagacagtaaaggctttgaatttcattctgaatataataagaaagctttggatggatttgagcagcagagtgactcatctaatatttttatagaaaggtcactcttgtggctgtgcaaatacactgaggagcttgaggaagaaatgaatcacagaaacaacagaagcttgggtggtagtggaagttgtgttaaaaattgattgaatttctaatgtattttaaagaataaaatatattagagtaacaaaatgttccaattaactgaaagtagataagagacagaagcatcaaagatgtctcttaagcgttttgcccaatcaaggagatggagatgacatcaactgcaattggtttgcagatccgaaactcagtgttaggtgagtgaagcttgagatgcctgttgacatgctaatattaggtaaatcaatatacatagaaacgtggaattagccatgggtcactatgacgatatgcatttgggaagcagcaagtattcacagatatgatacttagtgattattagacaaaccagaggtccttggataaaaacctgggacattaccttgtttaggggtcaggaagacaaagaagattcagcaaaggtaactgagaaaaaaataaaattaggtcgtgtcaaaagaaaagtaaagaaggaagttttaagaaagaggcagtaactagcttaaaaaaaaaaatcctatgacatacctattaactcctagtttctagttgtattagttttctagggctgctgtaataaagtactacaaactgagtggcttaaacaacagaaattttttgtcttacagtattggaggctggaagtccaatatcaaggtgtcagcagggttgactgcttctgaggctgcgaggaagaatctgttccatgtcttttttatagcttctggtggttttctggaattgcgttctttggcttgcaatgcatcactcaaggtctgctttcatccattcttagtattctcccagtgtgtctgtccaaaattccccctttatagaaggacagcagccatgttggatagggaagaaggtccagcatgacctcatcttaagtgtccccctaacagccctatttcttttttttattgttactagaaattattttattttattctattttattattattatactttaggttttagggtacatgtgcacaacgtgcaggttagttacatatgtatacatgtgccatgctggtgtgctgcacccattaactcatcatttagcattaggtatatctcctaaagctatccctcccccatccccccaccccacaacagtccccagagtgtgatgttccccttcctgtgtccgtgtgttctcattgttcaattcccacctatgagtgagaatatgcagtgtttggttttttgttcttgcgatagtttactgagaatgatgatttctaatttcatccatgtccctacaaaggacatgaactcatcattttttatggctgcatagtattccatggtgtatatgtgccacattttcttaatccagtctatcattgttggacatttgggttggttccaagtctttgctattttgaatagtgccacaataaacatacgtgtgcatgtgtctttatagcagcatgatttatggtcctttgggtatatacccagtaatgggatggctgagtcaaatggtatttctagttctagatccttgaggaatcgccacactgacttccacaagggttgaactagtttacagtcccatcaacagtgtaaaactgttcctatttctccacatcctctccagcacctgttgtttcctgactttttaatgattgccattctaacttgtgtgagatggtatctcattgtggttttgatttgcatttctctgatggtcagtgatggtgagcattttttcatgtgtttttcggccgcataaatgtattcttttgagaagtgtctgttcatgtccttcgcccactttttgatggggttgtttgtttttttcttgtaaatttgtttgagttcattgtagattctggatattagccctttgtcagatgagtaggttgcgaaaattttctcccattttgtaggttgcctgttcactctgatggtagtttctttagctgtgcagaagctcttgagtttaattagatcccatttgtcaattttggcttttgcttttggtgttttagacatgaagtccttgcccatgcctatgtcctgaatggtaatgcctaggttttcttctagggtttttatggttttaggtctaccatttaagtctttaatccatcttgaattaatttttgtataaggtgtaaggaagggatccagtttcagctttctacatacggctagccagtttccccagcaccatttattaaatagggaatcctttccccattgcttgtttttctcaggtttgtcaaagatcagatagttgtagatatgcggcattatttccgagtgctctgttctgttccattgatctatatctctgttttggtaccagtaccatgctgttttggttacataattggaagtaaagctctcctcagcaaatgtaaaagatcagaaattataagaaactgtctctcagaccacaatgcaatcaaactagaactcaggattaagaaactcactcaaaaccgctcaatagcacggaagctgaacaacctgctcctgaataactactgggtacataacgaaatgaaggcagaaataaagatgttctttgaaaccaatgagaacaaagacacaacataccagaatctctaggacacattcaaagcagtgtgtagagggaaatttatagcactaaatgcccacaagagaaagcaggaaagatccaaaattgacaccctaacatcacaattaaaagaactagaaaagcaagagcaaacacattcaaaagctagcagaaggcaagaaataactaaaatcagagcagaactgaaggaaatagagacacaaaaaacccttcaaaaaattaatgaatccaggagctggttttttgaaaggatcaacaaaattgatagaccgctagcaagactaataaagaagaaaacacagaagtatcaaatagatgcaataaaaaatgataaaggggatatcaccaccgatcccacagaaatacaaactaccctcagagaatgcaaacacctctacacaaataaactagaaaatctagaagaaatggataaattcctcgacactaactaaaccaagactaaaccaggaagaagttgaatctctgaatagaccaataacaggctctgaaattgtggcaataatcaatagcttaccaaccaaaaagagtccaggaccagatggattcacagctgaattctaccagaggtacaaggaagaactggtaccattccttctgaaactattccaatcaatagaaaaagagggaatcctccctaactcattgtatgaggccagcatcatcctgataccaaagctgggcagagacacaaccaaaaaagagaattttagaccaatatgcttgatgaacattaatgcaaaaatcctcaataaaatactggcaaaccgaatccagcaacatatcaaaaagcttatccaccatgatcaagtgggcttcatccctgggatgcaaggctggttcaatatacgcaaatcaataaatgtaatccagcatataaacagaaccaaagacaaaaaccacatgattatctcaatagatgcagaaaaggcctttgacaaaattcaacaacgcttcatgctaaaaactctcaataaattaggtattgatgggacgtatctcaaaataataagagctatctatgacaaacccacagccaatatcatactgaatgggcaaaaactggaagcattccctttgaaaactggcacaagacagggatgccctctctcaccactcctattcaacgtagtgttggaagttctggccagggcaatcaggcaggagaaggaaataaagggtattcaattaggaaaagaggaagtcaaattgtccctgtttgcagatgacatgattgtatatctagaaaatcccattgtctcagcccaaaatctccttaagctgataagcaaattcagcaaagtctcaggatacaaaattaatgtacaaaaatcacaagcattcttatacaccaataacagacaaacagcgagccaaatcatgagtgaactcccattcacaactgctacaaagagaataaaatacctaggaatccaatttacaagggatgtgaaggacctcttcaaggagaactacaaaccactgctcaaggaaataaaagaggatacaaacaaatggaagaacattccatgttcatgggtaggaagaatcaatatcatgaaaatggccatactgcccaaggtaatttatagattcaatgccatccccatcaagctaccaatgactttcttcacagaattggaaaaaactactttaaagttcatatggaacccaaaaagagcctgcatcgccaagtcaatcctaagccaaaagaacaaagctggagtcatcacgctacctgacttcaaactataacagccctatttctaaataaggtcactttctgaggtactagtggtaagcacttcaacatataaaatttagcgggacacagttcaacccataacatgatttttctatgtaatatagtttagaagtagctggtttggacatatttaacaagtccagtacttgggaaatatgctattaaaattttttccattatattacaatttatataaatatacttggatattgatgttctcttttttgttaatggaaaataagctgattttagaattttaacaaaacctccaatacttcttattttactttacatcaaggttgggtcaatatatctacattgaaatttcctcagataaccaaaatatcagacattaagaaataatctaggacattgtggaattttttatgagtataaatgttttgattaacttttgtgtagccataattattaagatactctttctaactgaggagctccctgtttgcaatactgagaaccagctatgtactacaaggtctagagataaatgccaaaggttgaggagaaaatatgtttatacaaatctctagaaatggcattttgaagtgaaaccttgatgccatttgatttgttataatttttttctttacaatttcatcaaaataaagattcaaaaagaaatgaatctggttaacgaagtccctgtttgattttaataaatcaaaccaatttggtttttttatgaagttatgtttaattcatattaaatcattttattaaatgtctgaggaaaaaaatctcaaattttaaaaactttaaaccataaagcagctcatcatagaacatgtattattttagactcttgtgctcattaaacacagaattggcaaacaattttggaaattgtatcatatatggaatgagaggagttaagacaacaacctaagttattgtccgtaaaagaaattctgcttcctaattcaataagcctttagagaacctaagttgccacagttacctcactaaagaaaagacaaacaacgacaccttgtggctaaaaaccttcttccatttttgacaattttgagtttccgaggcttgatacgaagttgtagcctttctagatgaatacacagcattagataaaagaattataaatatataataaaattgaacatacatattcagtttgtatgctaatgaaattagatttaaaaataaaattgatttcaatagctctggtttctttttcctataaaagtaacatttaatgtgattcaaaactaaccatctaaaataaaatcgtaacaacaaattacaaatgagcattttagtttctagtaatgtatccattatttagtataaatgtatattggtaaattggataaactgacaacccgagtacttcctacagctttatgattcagctaatagaaaccattatcacaatgctcgtacctgaagcacccaaaaaaaataatttctaagtcatagtcctttgatcaagactcaaaaacatacagcaaaagggaaaaatgtaatcttttttttcttttttttttgagttggactcttgatttgtcacccaggctggagtacagtggcatgatcttggctaactgcaatctctgcctcccaggttcaagcaactctcctgccttggcctcccaagtagctggaactacaggcatgtgccaccacacctggctagtttttgttttgttttgttttcttgtttgtttgttttttagtagagacggggtttcaccatgttggccaggttggtctcaaactcctgacctcaagtgatccgctcaccatggcctaccaaagtgctaagattacaggcatgagccaccgtgcccataatcattaacttttcttcaaacagttgtgtcgtctgtcataaataccgaaggtcccatcatatttactcaaaatactaaaagactaaagagaaagacactgttttttcatgacctcattaatttctcagtctggatttaaggcatttttatatgccaaatcattatttaggagacctattaaaagccatcattttctcacaggaagtgttaaaataaataggacgttttgaaaactagtcattatattttgtatctagaagtagctggggataagtgagagtcatgtagattttcccatgtttgtcgagatccacttgtcttatgatactgcttctgatcaaaatcatatgaatgcttctcagaaccattccctgagaaaaaacatctcctcatccttttagttttgaatttttctctttgtccattagatctatgactttattgtaaactacctcaaatccttggtggagccagctggttaggaaaacaaattaaaataataaaggatgaaatgagtaattatagctagcacctatggaaaacttactgcataaaacgcagtgttctgagtgctttacatgatttaactacaatttcacttcaaaagcctgtatgtatgtggtagatactatccccattttataggtgggacaactgcgtcattgattaagtatctcacccagggttgcagagctagtaagtggcagttctaggattcaaacgcgggcaattttctaaaggctgctatcctgattcaaaaggagagggaaacaccattggtttcccagcttggagacagttcagagatggatgccagtcatggtgcaaacaggagacctcagacaagctactcagcatccataaacttctagaggcttaaatgtatttaagcaatacatgtatttttcaagaattccaggattcagtgagctttctggtaaagctttggccagaagaccaccatcctattgcttataaattgtttgttgaggggaacaaagagggcatttaaaaggaaccagttcctatattccacttggaagtcttgggcttctagggaacaaccatgttttgattctccagatatcacgatcatttaacaaatgaaatgctgagtctgagaaaaataaaactgaatattacattcgaagtcgttttgccctaccacaatatctttcatggctccaaggcatgtcatcaagtgctcaaaatatcctctaaggaactttcacttaatttgcttgatttttaaatatatatttttaattcacctgatatttgaaagagccacaaatcccacaaattactgtatttactctgtggagcctggggaatttaggattaactgagcagttggggtgtggggggtgggggtggaaagtgttaaactaaaaataaaaaggtttaaaatgttttccaaaattcttgagcataagaatgtaggatttagtactctaattaatgggattagatggtttagaggagcttgaaaatggataaactggaatttttcacagtaaagtagacaattctaacttcatttaccttaaagtagaaaaattacattaactcatctgtatctccagagtgctgacacaaagtggatcttgtttatactaaatagaatagagaaaaaaattttcaaagactgggcaaagataaagctgcaataaaagtcatcagtgcttgaaacactcaaatgttccctgaagacttgactttaaatttccaatttaaatggaaaaactcttaaacagcatcacatttacaatggtgcacgccagttatgtaataggaggatagacataaatgccaaaggttaagtaaataaattggtatttatacacagctctagaaatggtattttgaaatgaacccttggtttctgtttgatttggaccatctctctttctcttactaatccagttcaatcaaaacaaaataaggattcaataaagactgaatctggttaacgaagttcctatcaatttcagtaatttaaaccaatctgtttctttgaagttatatttaatttatattgagttattctattaaattttttaaaatcctcaaactttaaaaactcttttaaatatgccacagttcaccatagaatacggatagaacctaaaataaaatgtggcttttagtgagtgaccaataattgcagtagtttttattgttattaagagttttaatttaaggaagattacataacacggaaatttatcattgaacttacaaagagcggctgtaaaaagggaatgaatcatttttaaaatgtcttcatcacctaagtttgcttatctaaagggaatctttagctgaaattttaattacctgatatgtacacctgtctagatcaaaaactttgaaaagaaaacttttttttttctctaattgccacactgtttaaacaagaaaatgataatcatttcttctatgtcaaacagatgtagatctttccagatgctgatagggaatatcctgacatatatagaatgtctttagctagtgagtcatatcaatataacagagtcataagaatggaatttcttcaggtaattttccattcaaacttgtaaacttatatgtgacccaagagtgtgtgtgtgtgtgtgtgtccgtgtgtctgtgtgtgtgtgtttggggtctatctagaaataaagctttgtaataaataataaatcaaaaaaaattagaaatttgtccatactattcatttgttttaattattttcttctaaagtttcatatttgtagaattgttgcttacattttatatactagtctcatgaatggatacagtctaggagatgcaggatatttttctgaccccttcgtgggactagtggcaggggagctatttactcagcccaccccactcaaccccttgcaggagggagtgagcgagagaatgagtgtgtgaaccaaaatgagtgagtgtaggaaccggcaggctgctttagccccagcaggagcaaactgtgcaggccctgtggcagcgtccaggtgggggtgcctgtgaccacaatgccccagagagcatgctacaaggctctcttagctccaccgtcatgcagacagcagcatgttattagctcagtgggccctttgcctcatcgcgtggggcagctatcttctgccagcaagggcaaagggccagtgtgacagcctttttgggtatctgcacttggtgtttcccgaattcttgttcagtgtccaagaggaatcaggtcatgacaaactgaaggatggtgaatgtggagaattttactaagcaatgaaagtggctctcagggaagaggggagctagaaaggggatggggagggcaggtcactctcccctgaagtcaggccacttctctgcctctctcttctgaagtcaagttgcctctttccagcatccatctacttttcctctccaccggctgagtcaggggtcttcataggcacaggatagggagcagagtaggccataggtaatcttggaaaaggcaacattcgattggtaaaaagacattattcacaaagaaccaattgggagagagcaggcacacagagatggaagttctcactttgggccacagattccaggctttttggctcaaaggtaaggttttgccagggactcacctcggtctgcctagaatttctctgcctcctgtcactatcacagggattccatgtttcttcattaagacaatgatgctaaaagaacaaataaaattgcttggttttggtatgttggggcttttcctcactaacatctttgtatagtcttgaatggcctttttccaacgccgccaccaacatctctgtgtagtcttgaactgcctttttccaacccccacccccgatagaatgtttgatttctcagtcaaatggaatctgcttcctttgcatcctattaaagaatgaacataattagccaattaggagaggatgagaccaaatcacctgggatgaggcagctttaaggtaattgcctaattcaagacaaatatgttttcatcattgtgataggcagtataatgccctccctcacactcccaagatggctatgtcttaatcactggaagctgtgaatatgataggttatgtggcaaaagggaattcaggttgctaactgactgcccttaaaatagagagattatcctggattatccatgggtttccacatggataatccaagggtccttttaagtggaaaatggagctagaagagagtcagcagaaaatgtgccttggaagatggtcagaatgctgcattgtggggactcagctgccttatctggcttagaagatgtaggaagggcagtgtaaaccaaggaatgtaggtggtctctacaaactggtaaaggctgggaaatggattctcagcttcagccttgagaaggaacacgacattgacaacaccttgattttaccctggtaagactcatgttagatttctaccccacagggctctaaaataatacatttgtgttgctgttaagccactgagtttgtggaaatttgttgcggcagtaatagaaaaccaacacaaaaattaactgagcggctttgatatactaaggtgagcactagggataggaagattcaactcagttaactccagtgtttcagtgaatatttctcattagggttgccagataaaatacaggatgtctaaatacatataaatttcagataaacaatcaattctttagtataagtatgtttaatatttaacacttactaaaaattattcaatatatctgaaaccaaatttcactgagtatcctgtattttatttgctaaatctagcaaccctatttctgattcatatgtctaggaagtttcaggaattacctctgctcaacagaactgctccctgctaaacatgccgaaacccttttcttagttatgttcctactatattttaggtctaatttatcatgcagggcctggctttctttatgataatagggccgcctggtttcctggtcatgctattattgtcatgaattgcaagtagggtcagtggatttttgctaaatgtgacagtactatatttatttggagcctcatatgcattgtctttcttggatttcatccaatttccatttctctcctgccaaaatactatgctgactatccaagcactgcttagagagcagtattcaggctctgaccctgggcataaatgtgctccccctgcttgttttaaataatctcatttccacagcagctgttgattctgctttgctgaactgttcagtaaactgtgcattaatgccattaaattagaacaaattagcatgccttctcccacagcactttcatctggctgttaacttacatttatgaaaatcatgactcatgcatagctgcacatttaatagtctaatattttcaaaaagaattatatagttcctttcaataggtttttacattgccagggaatgggtaagaatagaacatctgtttctgtaagtctgaaaatatattatggtacatgcccacttatttcaaattgactagcttttattctcatagtatagtagctataggtcagattaatctgtttctcattcagcagaatataaagagaaaagtagaatgttaattctagataagatataggggtacaattttaagttgatgttacagttacatcttccccttaatatatttggagtttattgccgaaataatttcttccaatggtaagagatttttaatatagattcttcaggtagccttaacatatgcaatgaaatcattttacaaatatatgtgactcccaaccataaacaaagtccatttctgttcattaagtttatgaattataccagttttcttgcttttttagaatttcagaacaattccaaataaaactacacaaaattttcattcaataccagtgtaatttttcactattttgcctatgtaataagtaccattaggcaatatagttataacgctttttatcttttccttttgagcaataccaaaaaaaatggtggccattctgatttgataagatgtgtaaaacacaaatctccacaaacatacaaccatcaaaggtcactttacagataaagaaaccatagaccctaaaaagacaaagagtttgcttaaggattttgtggtggttgataaggttagatagaatacaagataaaaacgtgaagattgtaaagcaagagcagaatcgcaaaacgttgagaaacaagggtaaaaattgcaataccataaagataaatatcttgcttgaaattgcccatgactttggcagtatatgttttcttaaagataaataacaaaaagttactgtttctgcattttaaacaaccaattaaactaattgctcaggaaaaacacaaatattatcagtcttaatactacatatgaattccttcttgagttcctcataaggagtacaccacggaacagataagcaagacatcttacaaactccagacaagaagcaggtcaaaaatccaagtctgcttttattccaccagactactaagcaacattgttggtttctgattcttctcaacaaacctgtagatacactataataccttccattccttctacctttcagtgaggttgatatacgtgttttttttctatgaaggccaattccctccaatcataacagaagataacattttactatctgtgctttttattttttataatgtttaactagaatgaaagttacaggaggatgtgttccaaatgtgtagtataacatagaaaaaggtacatcatttttgaagaatgactaaaaggatatggtctagctttagtatagatgaaaagagtgggacaatctcagttctctgtatagatccatataaaaaatcaccgcagtttggcaaatgtgctcatcaggtttggttagcataacagttctagaggaaaaagaagctgggactgctaataacatgcaaacttctgtgaactggctttccagggcttactttcccaaagtagccctgaaaagatggcttgcaattccaccccagccctgatttcagtgtaccatatgtctagtggtgagttgagtgcagctagaagacgcttcattccaatttcaaataaaatatttatctatctacattatctcattcaaagaatcttaaaggcaaaaaatgaaacactccaaagaacaggattcttttcagggtcaatgcactagttgaaattgtaaaaaatcagcatcttgtcttgcctagtgttttctttcattgtttaatataacttttctaggtctgctttgtaccaattagaactctgtttacatttatgcatagagtaaaaataagcagtgctcattttcactcttgaggcatgaagtttctgaatagtcaaatataggctacattttatattcctaagaacatctcttttatttaccatatcagaagggcaggtatttttttaatatccataggtttttatgttcttatttcaaaaaaaatctcaaatatccacaaaagcagaacaaataatacaatcaaaccccatggatttattagtcagtgacaacaggctgcaactctaggccattctggtttcatctatacccttaccttctaccttcccccctacacaattactgtaaaacaaaccctaaagattcctatttcattgtttaatatttgtacgtaaagatcttaaaggaaacaactttttcattcaacactaccacaattctgttatcacactaaaacatttactagcaattccttagtaccacccaataaccttgcaaacccaactatcacaccactagataatctcatgaatagtttttagcagtgcttggttctagaactttagactttagtatagtaacaactctatgagttagatatgattattattctcctgagaaatgaagaaaatgtgtcttgagatagtaacacaagacagtttggttccaggtgatgtgctgtatgatctgacatgttctattaatttcctcctgtaaatatcatttaagggcctaatatacagcggggagagtaaagggtcattggaatatatcagtgaatatagtagacaaaaatatcagcctccttagagctcatattataatgaaattagatagaaaataaatttaaaaataataaataggtaaatgctctcacttgataaaggtaaaagtactgttggaaaaaaagaaaataatatcacagctgacttgtggttccaggaaggatcattgcaattttaaataggtattcggggtaggcatgattggaaagggcaaagactttcaggagagagaagtaattatgcaaatatatgcccataaagagagatcccaggaccagggcctcaattgggtaagagagggggaagaatgaattctaatatcagctaaccaattgtttcattccttgtgccactggaggtttaagcatggaactgttgtacaaaccgaccaatgagacctgagcataagcatggttagagtttcaaatgagggtttcctccaatgattaaaggactcataggaaaagagacagtctgaggatgacacttcctatcaaaatgtcaaaaagtggatgccctcaaatactgctggcagagcataatttgctgtaattttgctgatggaaaattaaataatacacttgaaagaatactagtaaaattacgtgataaatattataatgcctgtagctaaattttgtctattgtcatgtatcagacatggtgtaatgtgtcttacatttaccatcttgtttaatctttaaaacaaccctaccctatgagttagatgtgattattattctcctgagaaatgtagaaaatgtgtcttgagaaagtaacattattttctcagttttgcacaggcaggaagctagaagggattttggagtctatacttaaatatttgatctaagaaattgttaaaaatagatatgaaattatatgcataaagttgtgtaccaaatgcttattataatgtgaaactttgagagcaaaatcaaaatagcattgaggacctgttcaactaaatttggctacttctgaatagagagttagttaaacacattgcaatagttaagattcctgaataaaatattgtacagggaaaagacaccagagaaaggatattgtaaaacatccatttttagacattgaggagaagaaacatatcagagaagttgaagcataagcaataattttatgtgtcacaggagaagagggaaggagtagtgaaggtggattaagcaaaatgaccaatttttcaaggagatggatttgctattgcctttgaaaactgggagactattgatgacccttaagagtgaagatttcagttggtatctaaagacagacttcaagacataataaaaagaagttgaaactgtcatttcaagacatattatggtaaagaaaaacaagtagaaaataatagatttatctttgactctggagtgaacagagtatctacagaaattttttttttgaggcatggttgtagtagttcagataagaattgaactaagtgtggttcacaccaaggttttaacttgttttctcctttaaaatccagcttttgccttcaccacactaataaaactgttctggataaaaacgttcctttttatttctgtgccttagatgtattacatcatttgagctatctttgtagcccaggatatcataaccatagggatcaaaaattaaaagcgtaactgaggctgaggctgagacaggagacctgcatgaacccgggaggcagaggctgcagtgagccgagatggtgccattgcactccagcctgggtgacagagcaagactccatctcaaaacaaaaacaaaaacaactatataatagggtcttactattcttctaagaatttcagtctgaaatttcagtctgaaaaagttccactcttttcatgtaaacgttagatttctagatatgtgtatgcatactatggctaataaattcaacagaaggaggcccgcatttatttcatagaaacaataatttagtgatggtgcatgtgatcttatgaattctttagacctctggcagtcatacctgacagattcatggcaagggaaataactatttacgaaaggatacatttgcttgtctgacatgtttgaggaaccctgcctttaattacataagcagatatttatatcttaacaccaattatgacttattaattctggcagcaataaagcaactaaggacatactgtcactcctaaatatgtcacgatgtgaaaaattaactcaattctagctaagttgccatgcatttttaaatagcaaaataaatatgactaaataacactctgacttcaatggattaaaattaagcaaatttttcaagtaatatttactgctacccagtttattaaaccacatctatcaatgaaagcagagccactatttttagccttttaaacttcctcaaatataagatatattgcagatgagtatgagctaaaactagagaagctctaaaaattgaaacaaatattttgcaaggatacagttcacatttaccacctgatagttaaaataattactttgtgttgtgaaatctagtatcttaaatgaaaacggaggacatagaaaagtataggctcttgatttattttgaagaaaaaattcttaattaatttatacaattcaatagtccttgtttatttctgaaaccagacttatcaagatttacaaaagatgtatcttctgatgatcaatgtattacatttttgtgacttattaatcaaatggtggtgatgaatgtttttacattaacagtattgtgagggcaccccaaaattattatatagatattagggtaattctatcaagccataactttgcagtgatcatcagatttaatcaacctatagagtttatttggttgatatattgatgtccagtttctctctcagtaatttgtaataaaatttgcctggggacagaatattgtaacagttaaatgataactgtttcatcagcgggagtttaattaggttagcagctgtattctaaaagcatccacagaatgctttttcctaagagtcacgtgagcctagaaaccagcacttccactggagtatatactttgctgtcctgtcatctctagctcatgcacggctttaacgatgcaccacaaatggcacctattacttgagtcattctcagtcataaacttttcctaaaacatgaagactccctgtttgactctgcctgtcaggatactaggagaaatacacagaattcattaacaatattgataaaactatataatatttttcatgtaatggcactatggaattcctcatattgtcttcactaggtctttgaccctgctttactctcctagaatgccttcacatgtgaagcatcttgtaataccttttgaaacactgtctatacataaaactataaaaacatggcaggtggaggtaaaagtcctcttttctgtatacatgcagagacgttacagataaaatataacacctaagatttagtacatgtcatagttcaaaaaagagaaaattatctgcatgtctaaagtgaagaaagacagaatgataaatttgaaagctgaggctatgtttttaggtgcacagacatttaagactactatatcttcctattgaattaacccttttaccattgtgaactatccttgttttaatctagcttaaaatctactttgtctaatatttaaatagtgacatcactttcttttatttaggcttgcatggtatattttgtttgatggtttcactttcaatgtatctgtgtctttatatttaaaatatatctttaaaaatatcatgtactttgggaggccgaggtgtgtagatcacaaggtcaggagttcaagaccagcctggccaacatggtgaagccccatctctactaaaagtacaaaaatcagctgggcatggtagcatgcgtctgtaatcccagctactcgggaggctgaggtaggggaatcgcttgaacccaggaggtggatgttgcagtgagccaagatggcgtcactgcactccagcctggatgacaagaggcagactttgtctcaaacaaacaaacaaacaaacaaacaaaaacaaaaaaaccccacatgtaatagggtcttactattcttctaagaatttcagtatgaaaatattttatgttattttagtatatactctgtactcattgtcattattgattcaattgggtttaagtctactgtcttctttgttctcttagtccaatcgttctttactttctttatgcccctttcctaccttcttttggattattgaagtgtttccttttatattccatttaatatcctctcttaactcttttttatagcttttatactattattttagtgactagttattggtgacttattagagcctgactcaaattagaatattatcactttccttaaaataaatcttaccacgttttaacttgagttatccccttgccctttgttctgttgttatatctatttaccttcacattttataaaaccacaggcataacttttaacacagaaattaatgtttctttaagtagttgctgttttttcttattttctcacatatgtgcccttttcagcatccttgatttatgcctgaagttctgtattttcatttggaatcatttttcttccacctagagaatatattcttgtagtgcaattgtaatggaaacaaatactctcagtttgtgtttatctgaaaagaaaaggcttccttttgcctttatttttggaagatattttacttagtgacgaactctaggttgaccatttttccaagactggtaagctatatgctaatttgcattatttgtgtgcaaaggaagctgaaagttttattgttgctcttttgatgctatcacatttccaaacccccactctagagggtttagaattttctctttatctttaattttcaacagtttgactaatatacacctaaatgtattttctttatttttatcctgccaatctgtatgttgcatttctcatcattttaggaaaagtcatgccaccgatctctttaatattttctctgtcccgttttctctccattttgctgtcactacagttacataaaacactctgaaatactctaggagacaaataatagctaccaatttttatttatctctaaaataagttatatttcttacactgtgtagtatcttacaacataacatagatgagaggacagttctgtaaataaaacatatcacctgggtagtaccatgtattttcagattttcaaaccaacacttgttaactctgttggaaataatattattacaaagcaatacttttagaagtacaaacttactgtacaattcttttatagaccgatacaaagtagatgttttattgtctaattttgttaaatctaatgcaaataatctctgtataattgtgaaataattcattttctgtttgctgtttgttttctctccatcgcaaaagcccaacctctgtatcagggattgcaactctactctccagtttccaaatagttaaatgaggccaccatcatctgtgactctatagtgagttcattaattagctgttctaaaatcactatttttataatgtttctctttcccaatcctattatcctcaaaaccctatcccaccgccaaggtctgtatgtaggaaaaaataagctctccccgatacggtgtaagtaataagctcttcccactatggagtacacaagcagttcttgaattttttggtcttggaaactgattacactcttaaaaatttttgagtatggcaaagagcttttgtttatgtgggttaaatctatttatggttaaatctattgacacatgttagaaatgaaagctgaagatgtgttaaaatatttatttattaggctatttaaaaatagaaataataaacctattgcaggttaacataagtaacacttctatgaaaaataagtattttagaagaaaaggtgaaaagagtatcactgttgtacattttagcaaatccctttaatgtctaacttcacagaagaatgcttctgcacacaatctgttatgaaatggcacatcttattatctcttaaaaattccctcaagggaatgggaattttaaaaggcagatagtgtcttagcgttattatgaaaattattctgatttgtagatcccagaaagggtttcactcacccttcagaggtccccatgccatagtttgagaactgctgatgtagatattaagatttagcatgagtggaaagtattgaattaaatacacagtccaatgccctcgtttaaaaaaaaaaaaagctgataaattcttacaggctttcccagctacttggtgacagaagcagaatgatgacccagatctttccccttcagcatttgttagaggaagtaaaccaaatattcttggtaatgaggattaaagtaaattagacagtggcatagaagattaatgatgggacctcagacatctgttgacaggtttggaggtattttaggagaataggcctttcagcttctcccaaatcaaaccaattagaggattccacattttgtctgtgtcaaatctacctccaatagcattctgcctcatcttctattgtgatacaggcacaaagacattctaggagaaaataataacaatgaaaacaacaaaaagtctcttcattgtctattactagagatacaaaaatgtcaaatagggacatggaattcttccttactggttgtgacccatgatgaagatactcagcttggtcagctgtgttttctgcagccccagatcatctaaagaagttttggttgtccttcagtgcctcaagagactgtggactatttcaccaacagtgcttcaggttattaaggatatggcttagcgataccatcataacaagacagggcaaagcaccatcactgatgggcatacatgttaagatgcagctcccttgtcgtgttacatgataagagaccagtagagttatgcattcaggagtcgggctgctggagtaaaaatctcaagtctgcctttcacaaattaaatgattagagaaacttcaaatagtaaccttagactacatactggaaattaaaataaataacaatcaatgggagggttttttttttttttttttttgagacggagtctcgctctgtctcccaggctggagtgcagtggcgccatctcggctcactgcaagctccgcctcccgggttcacgccattctcatgcctcagcctcctgagtagctgggactacaggcgcccgccaccacgccctgataattttttgtatttttagtggagacggggtttcaccgtgttagccaggatgatctcgatctcctgacctcgtaatccacccgcctcggcctctcaaagtgctgggattacaggcatgagccgggaggggatttaataagctaagtaacataggcatattttttagagaaaccagagtaatatagtaatacacttggggaaaatgtgtttaaaatggacacaaacacgtttgtatgatataattatgatacttttcttttactgtcagatatcttgccattttatacttaagctatgctaggttcttcttgatattcttaacagtgctttgcagttcctttaagtgccataatttaagatgaaaacttattctgaaacttaataattacttgttaagcattttccacagagaaaattaccagtttaaggctttcatttaaaatatatgctactagaaatataatattattttgataattaataaactagattttgcttctttaataaatatggttttccttaagtgtgtgtgtatgtggacataaacattactatgtattaactatacatagaaatgtatatatgaaatatacattatataaatatatattaataatatatattcactatatatttgtaaagaaagttttcaatatatatttatatatttatatagtaaaaattatgtagtgaaaatttactagttctgaaaattaggatatgttttttcataaatgaatgcagaagaaaaataacagcagaacatgtggcttcggaggacctgtttttgttctgtaatgtttcagcttactgaatttttcatgaactctttacgttgagtattaaatctcaaagcattttaaaattttctccaaaaatcaaattttgttacttttcattttttagggaagttatcatttatcttctgattgtttcaccctttcctaccagcagtagaatgaatataagataaaaacaggcaatgtatggcaaaagaattccaaagggtcaactaacagatgaaaaatatttcataagcatatattttccagagaaatgcaaatgtgatccatcattacatgccattttacttctatgacattggaaaaaatggagaacactgacaatcaaatatgtagcacattatgtggagaaaaggtcactctaatactttattatcggaatttcaatcaataaaatagctagtaaacatgcatctttttacgacttaatgatagaagaattctgctattgactatgcatctcgaagtagtcattgtgcatgtgcacaaggagacatgtaaactatgttcactgtaacagtgttcagaaaagaaaaatttgtaaacctaaacccttagtaaagaaagaagatatatgtcataatatacttttatatgacatataacttataataggtagactatgcttatcatcatggtatgttatgtaccaaatactaggatgaattgaagctctataacaacctggttaaatatacttatggttaattacataaagctatatattaaagtggctgtatcttcaaaacaatgttaaaaagaagcaagctgcatacactgaaatatatccatatgtactaaaagtctattaaaatacagataaaatgatgcaattctattcataatagctgttaattcctttttgtttttcaaattatttattattcttattgtttgtatttaggacatacgacatgatgttttgttatacaggtacataataaatgcttactttaggtaaacaaattaacatctccatcactttctatagttagttcctttttttgtcaaagagtgcctcaaatctactctgttagcaaattttcaatatacaatacagtatttttaactataatcttctattgtattgactttatatctttagatttattcatattacattgactttatatctttagacttattcataatacataactgctagtttgtgccctttgacctttgtcttctcattttctccccattcccatactattattttattgatatttgtatttgtacatctgtgtaggtaatatggtttgactgtgtcctctcccaaatctcatgttatagtttccataatccccacatgtcatgggagcagccagtgggaggtaattgaatcccaggggcaatgatccccatactgctgttcttgtgaagtcagtgagttctcatgagatttgatggttttataaggggctttttcctctttgctcagctcttcttcctgccatcaaatgaaaaagaaagtgtttgtttccccttctgccatgattgtaaacttcctgaggcctccccagccatgcagaattatgagtcgattaaacctctttcttttataaattacccagttttgggcagttctttataacagcatgagaatggactaacacagtggggtacatgtgttattttgttacatgcatagaatgtgtaatgatcaagtcagaatattcagggtatccactaccctgagtatttattatttttatgtgttgggaacatttcaagtcatcttttccagctttttaaaaatatataatacattgttgttaactatagtcactgcactctgctacagaatattagaacttacttcttctattgaacagtttgcatccattaactaacatccattcatcaccccactcctacccacacaccttccctgtctttggtatctatcattccgtactatatcttcatgagatccagtttttaagctcccccatgtgagtaagaatatgtgctatttgtcttttggtgcctgtatgattttgcttaacataatgacctccagttcccccatgtttcagcaaatgacataatgtttttcatttttatggctgaattgtattccattgtgtggaggtaccacattttatttatccattcatgcactaatggatacctaggttgattccacatcactgtaaatagtgttgcaataaacatgggggtgggtgtggaagtatccctttgatatactgatttcctttcctttggattaatagtgggattgtttgatctgtgtgattggcagagcactcatgaggccaattttgagctccagaagaggtgtgcattaggggggttgggtcccagtagcaccagattcctggtttctgaaagaagactgagtgagtgttagaggaggaagagcaacatctaggtaagaacactccaaggccactgcacagttcgagtaccacatgccattcacatccagcacaaattggcagtggggtgtccctggaatagccacaatactcaagtaacgtctgcagacaaatcctccattgagaaatgagcagaaatttggccaaatgggacagtactccacctaatttggcttatcacaagtacctgtagtaattgttaaaaaggggacgatgacctctttctcagcaaagctggcctttggcgtggaatactgaataacaaacattcagagaaaactgtctttagatttctagtgcattattcactagaagtatagtctataaaagcaaaacagtttcactgacaaaatagaaacataatagaactgttttttttttcttttttaaaaactatggaaccagtgatgacttctattcattttaaattttttattatgtatatttaaggtgcacaacatgatgttctgatatacacatatatggtgaaattattactacagtcaagcaatttaatatatccatcatctgacatagttgcctttttatatatgtgtgttaggagcaccagaaatctggtcccttagcaaatttccagtatataatacaaatattaactatagtccttatgctgtgcattaaatctctagacttactcatcctttataaccaccgcaactttggaccctttgacatacattgctctatttcccactcacctttcgtaactactgttctattctgtttctatgaatttagcttttttgttttgtttgcttagattccatatataagtgaaatcatgtagtaattgtctttctgtatttggcttattttacataatgttctcaatgttaatccacattattgcaaatggcaggatctcctcaatttttaaggccgaataatattgcatcctatatcctatatatgacaatttccttatcgattcattcatcaataaatacttagaagttcccatatcttggctattgtgaataatgctgcaatgaacatgggggaacagatatctctgtgagatgcaattttatttccattggatatacactcagaaggattcctgggtcacatggtagttctgtttttaatttttttgaagagcctccgtattatttcccataatggctgcaccaatttacattcctattaacaatgtccaagggttcccttttcttgccaatagttgttttctcttgtctttttgataacagccgtcctaacagtagcgaggtggtatctcaatgtggttttgactggaatttccctgatgattagtgatgttaagtacctttcatacacctgttggctatttttgtctcttctttgaagaaatacttattcaagtcctttgcctgcttatttatttatttatctactttttattttttgagacagagtctttcttgcctaagctggagtgcagtggcgcgatctcactgcaacctccgcctcccaggttcaagcgattctcctgcctcagcctcctgagtagctgggattacaggagcacaccaacactcccagctcattttttgtattttagtagagatggagtttcaccccttgttggccaggctggtctcaaactcctgacctcaagtgatccacccacctcggcctcccaaagtgttgggattacaggcgtgagccaccgcacccggccctttgtccactttttaattggtttgtttgatttttgctcttgcatagtgtgagcctcttatattttcgatattaagtgcttattatatatgtggttcactaatattttcttccagtctataggctgtcttttcactctgttgttttctttgctgtgctggatcatttgtttaatgtagctccagctccactgttttatttttgcctttgttacctgagccattggtgagatagccaaaaaatgtccaagggcaatgtcaaggagctttttccctgttttctccttggagttttacagtttcaggccttactcttaggtctttgatccgttttgatttgagttttatgtatgaggtaagataaacatctaatttcattttttttacttatgagtattcagattttccagcaccttttattgaagatactatcctttccccactgtattctcttgctgcccttgatagaaattagttgatcatgggccgggcgcggtggttcacgcctgtaatcccagcactttgggaggccgaggcgggcggatcacgaggtcaggagatctagaccattctggctaacacggtgaaatcccgtctctactaaaaatacaaaaaatgagccgggcgccatggcgggcgcctgtagtcccagctactcgggaggctgaggcaggagaatggcttgaacccgggaggcggagcttgcagtgaaccgagattgtgcagctgcactccagcctgggcgaaagagcgagactccatctcaaaaaaaaaaaaaaaaaaaaaaataggaaattagttgatcatgaatgcttgagtttatttttaggctctctattctgttacagtggtctatgtgtacgtttttatgccagtaccacactttgtttttgtaatattatttgaaatccggtagtagaatgcctccaacttaatttttctttctcaagattgctgtggttgtttggagtcttttgtaatctaaaaagcagcttaagagtagtaaacagattttgaaaatgatacaaaggtaatcaggcctactgaatcttcagatggaatcaagttgaaacagtctcctataacactttgataatttgcagaaaaattttgcctttagaggattctagcaaacctattctcagttcactcaaattatcaagatcttctgaagttattcaagaataactttctattttggccatattccaaagtcaacttgaggtgtaggagcagagtgtatttgcgaaggagtaggagcaagacagagtcgaagtgggagggagaagcacatacgactcggaggaattctggacttcattcctttaggtgttctctaatatacccttagcccatttccaattttcaagcaagcctctaaactaatccttacagcttgttacaggttcaacgaggacgcaaactcttcactacccaagagagctataatctatctatttacgcattttttctctcattttctgggtttctgacagcttaacttgactgaactcacgaataagggcaccaagctgattaccttgcatttcctgccacagaacaattgcctgagaagttttgtggaaaaatgaatgcaaattccacaaggaaggaagttcatactcagaaagctctttttaaactcattaaatccatggcttttggaaagggatcaaggagagaagctataactgaaaaaaatcaagaaagcattcaatgtaatctgctttccataatgagggttttttttaactatgtatattcatcaatgaaataaaattagataagccttgaagaagtgtactagcaataactattgtactaaaattataaggtgtagaaaatgaagaaagtaagagacagaatgatagaaagagaaagagggagggagggaaagaaggaagaggaaaataaagttaaaatgaattcgacagaatagctacatatatatttaaatacaaactatgtaatgttaatagaacatgccaaatacacaaagcaaaacaggaatgagaagtcttacggggccataattttgcatgaataacatcaacttttgtggtaaagcagggcaaagacaggaaatacagggagaagcactttaaaatttcagaagaatttaatgcataagaggtttctttcggattacaaaaggtccaaagtccaagaggtggcaaggccatttataaagactttatcctgcacaataaataaaaaaaggaaaggaaaggtaaaaggaagtaaagaaataaggaaaggaagaaaataaaggagaaacaaaggagagaaaggaaacaaagaaataaagagtgagaaagaagaaaggaagaaagaaagaaagaaacaaagagtaagaaagaagaaagaataaaaaagagaggaaggaaggaagggggagggagggagggaaaagaaaagaaagaagaaagaaagaaagaacaaaaagaaagaaagaaagaaagaaaagagaaagaaagagagagagagacagaaacataagagaggactttcttcagctatgtgcaaaatgtggagtgtagctgatcacaacatgtccagttagccacagttttttcattctaagtgtcaactgttttatgtataaagaaccataatagaacatataaataaaatatatccatctgtgcatatctgcagtacatggaaagtatgtcctgttgttaaaagtccttcataattatggattttgagagccactagatgtcagcatctgataattctatgagaaacacacatgctggctttttatttctgcgacagactttctgttcagccattttcttcatctaaatgaaagtgaaccagaaattctataccttttaaaatactcatattacttgtaagaagataaacaattaatttgatgttactatttttacaattatgagttttatgatatgttaagcagatatgaataaaaatatcagcttctgtgtgtttgtgtatatgtatatatacacacatatatacatatacatgcatatatgcatgtacatgtatacccacatatgtaatgtgcattgccactatacaagaagaaactgcttaaaatattttttacctccttaagccctcaacaagtgtttcctttcttccttcaagagagcatttcatctgccacatcacaggaaataatgaagatatctgaagttctccttcttgtttttattctattgcagatctcatcctttctacctttagtgtggatatttttggatactatatctccacacctctgcagatctgtttccttgagggataaaatggtatcttgtccatcatatgtgctgggtaaaatcagtgactttgtgaatgaattaacacatgagttacttaactcattgtagggaaataatttttaaagcaagttatatctcttaagccagcccatgagttttgaagaagtcattctggagaatgcatatcattaaatttcctgagactacagatattcagtatcttcaaataataactgggaaattgctgtttgcctttctcctaatatcactttttctcaacacctaattttgtagaggagggcagccagagaaagagagagggagagtctgtcttcattccaactgtgatggcagatacaatcaagtgacatctaccaaagccctttgctgcagttgacaatggaatattttgcaaaggctatgtatgtgtaaggggcacagatggtggacctggggaatattaacacaaaggtcctaaagactggttatgcaatggttttctgttgtgaactcgccacagtttgcctgcatttatccttcaagtcttagctgtgagatccttctttcaatcccaattctagaacaaggtctctccttttctctgggaaattgtagctacagactgagactgtaaaatccattcacttaacaaaaatctattcatcccaactctctgtgaggcactgtattaggttctgtggggggatacaaagatatattcaaaacagtccctattccaagagtttaaaatgaatcatctaaaaaaattacaatcctttatagtcttaatattccataagtgattggtacttcaaacccatatagcacaattagtcagaggacgttgaatcatcttaccaaaaaattctcattggtgcatttaacacaaaaaaaattcaaatcttagcagttgactttttttagatgaagtaattgaaatacttagaagaaattgtttgcttcaggctatggagtgagctgagattatataaccatcttcactagtatgctgctggtattcagttctaatgcctgtaaaatcttgattgaaaacaatttattaagcaataggtacaacagcaaacatgaattcatgagtatgtcttcattcagtagcactgttaatacaacaatgttgcacgatggctcctggacaccaaatatttagtggaagagactttatttcagctatctcagaagaatatgtcagatgaatttctctttttacttcaaatctattaaattgaaggtttttcccatttttacctatttcctctcgatctattcactctttagtaaatacgctaaaaggatgatgaggcaagagatcaggtgtgtccatgtgcacctggaaacattttctctctcttgctggtgaagggagtgctggcagaagcagacctgtcactcaggcagagggaacagatggagtgagaaaatttctacatacaggcagccctgaggagctgtgtggagaacatacgcaacaggcatttcattttcaatctgccttcgcactgtatttatgattttgtgaaaatgtctggtttcttaactgaatgctgcattgaattgcctcacaaacttttatgttaatcaaacaatagctcttcaggtagcctaaaaaacaaatcacagacttcccggggttgtgcaagaaaggctgaaagcagaattttgtagtttaaattttatgttttatgtatgtatatttttgaacatggtattgagaagatgtcagatatgggtgattactggtaatataatgaaaagtgtattatatatgcgtgtatatatatatacctattatttaataaaatctatatgaaatgctgttaaaaaatcagcaaaattaaactgtagaaaaatgatagctataaatttaaggacaagtaactaaccaatcagttactgagctggaataataaattacactgaacagggactgacttgaagacagtaaagcccgtgacattattcattttacctgtgtcctgtaaaaactctcagacaatggaaagaaatggtatttacagaagaaaataaattacttgtcattgtagggaaaaaaagctttgacatgtatagataataaggtttcttagagttgcttatccttttacaataataatattccaatataccagttttaactatctcactgaccttcaatttcatagctcctagaggacccacaaagatctagggactgaaaattcaggggaataagccaacgaatttaccaaacataatgagtgattactgtgtttgtatctaaatgagctttcccagagagtaaaataaatagataagtcaaaaaattatttccaaagccactagatttcatctttataatttacacttaatgatcaatgtcttctgtctgaaaggaattgtaggaaatgggatatagaagggaaaggaagaaatgacatctgtcttatttggtgctattttcttcctcttccctttttgccaggtaattgtctaagctgtggctgtgacagtaaaggaagaatgaaggaatcgttctgcagtgggttaaatagtgacccctgcaatggactgaattgtgtcaccacaaaattcataggttgaagccctaaccttaatcacatacaagggactgtattggagatgtggcctttaagaatgtgattaaggttaagtgaaatcataaggatgcagcccttatagatcctatggaattaatgtccttataagaagaggaagagacaccagggcaccctccctgccacaaaagaatacagcaagaagacagtcatttgcataggcaggaagagaacccttaccatgacacagacatgctggcatcctgatctcaacttccagcccctacaactatgagaaaataaatatgtacagtttgttagccacccattctgtgctattttgttatggcagcagaagactaatacattccccaaaatatatgtccacccagaagctgtgaatgtgatctcatttggaaatatgttcttggcagatgtaacagttaaggatttcaagaggatattatcctggataacagtgggccgtaatcaaatggcaaatgtccttataaaagaagagaaggcaagaagacacacagaggggaaggtaatatgaagatggagacagaggttggggtgatacatctataagccaggaaacactaagaaatgctggcaccaaaagctagaagaaggcattaaatgaactctccttcagaatctccaaaataaaccaaccctgttggtaccttgccttgaaacttcttgcttctggaactatgaaagcataattttctattgttttaagctaccaaatttggacaacttgttacatcaatattaaaaagctaatacaagtgctcatttacaaccaatccatcagctaggcattactgaacacatttcctaacaaaaagtttgtttgtatacaataccaagaggcaatgaagaaaggttccaagtgtgttttgttttgtttttgttttatactcaattaccatcttcagatatctggctccaacaaatactgatctacctctgtcaccacagttggcttttccttgaaggtcatataaatgaaaacatacagtatgtcatcttttctgactagtttctttcatttatataatgcttttgagagtcatccatgtttttgcacattttagaagtttgttctttatattgctatgtagtgttccattaaatgaggtatccaagttgatttctgtgttcactgatgaacgggcattttggttgtgtgaaactttgggccataatgcataagtcactatgaacattcaggtttgttgatttgtgtataaatatgttttcattttttcttggttatatacccaggagtggaattggtgggtcatatggtaactctatggttaattttttgaggaactgacagtcttctttccaaagtccctgcactattttacattcctgtctacagtgtgcgagggttccaatttctcacaacctcatcaatacttgttattatctgtcttcctgattatagctatcctggtgtatgtgaattgccatctcactgcagtttcaatttgcaattccctaatgactaataatgtcgagcatgttttcataagttagattccatttacatatttttggtgacctatttattaatatacattttgctcataattttattgagttgtttgtcttctgacagatgagttatgggttatgttttggatacaagtcttatttttcttttattgttgtgtcttatgaaaaaaagtttttatgtagtccaatttattaattttatcttttatgctaatttttatgttttatttaagaaatgttttactaacccaaggtcacaaaggtttattttctgttcctttctacatctttcatagattagtttcaacatttacatgcatgatgttaattttaggttatgcgtgaggtaagggtcaaggttcatttcttgtagagggatagacaattgttacagaaccatttgttcagatgcttattctttcctcattgaattacattagcacctttgtaaaaaaaaccagttgatgtataagtatcaatctatacctaaactctgtattctgtttcactggtatcagaaattgcgttatcataattaataaagccgtacagtaagtcatgaactcaagtagtgtaagataagcaatgttactactttgcaaaatggtttaaaagtcttttgtagttgtcttatctagccctttgtagtttcatttcaaatcaatgtgccaatttttagaaaataatagtctggtgggattttgattgagattatattttattaacaaatcaatttatggaggttgatatctaactacattgagttttcatagccatgaacaaggtatagctctccatttatttagatcttgtaaattattactcagcaatgtttatagttgtgagtgtataggtgttatattcactttaaaatacaaacttaaagattgttagattattatgctatcatatttttttattttatttttcttctgattattcctaatatacagaattttaattaatttttgtatattgactttcaaaactgcaaccttgctcaatacacttagttctattggcttatgtgattgttaattttatgtgtcaacttgactgggccacagagtgtccagatatttggccaaacattattctggctgtttctgtgaaagtgttcttggatggcattaacatttaaatcagtagatttagtaaagattaccctccctaatatgggtgagcctcactcaatcagctgaaggcttgactagaacacaaaggctaaccctcctccaagtaagaatttttctggcttgatgctagtggacttttaactgggacattgacattttttctgccttcagacttgaactgaaacatgagctcttcctaggtcttgtgcctgccaatgtttggacagatactattccatagactctcctggttctcaggccttcaggcctagactagaactaaaccatcagctatcctggttttccagcttgccaactcaccatgcagatcttgggacttgccagcctccataaacacgtgagccaactccttataacaaacaaatacacacacacacatgcacacacacacacacacacaaacacaaataccctattgattctgctagagaaccctgactaataaagcttatttacagatcctttagagttatatacatggacagttgtaaagcacatcttcaaaaaagattacagctaacgtcatacttaatggcgaaaaatgcaaaactttcctactaagatcgggaacaagacaaccactctttttcaatgttgtactggaaatctgagctcatacaataaggcaagaaaaggaaataaaagatgtacagattaagaagaaagtaatgaaattgtgctttcggaagacatgattatttacatgaaaaatgcaaaataaaagacaacaaaactcttagttaattttatgcccagcaaagtggagggatgactcccttgattgctgaacaagaatctccctaagattccctctaccaacatctactttaaatatctgattggagtcttatattagtctttcagttgttcttgaaatatatctggaggtttcactgagatattgataataaaatgtgctgtttgaacatgtacgttggcatcatggtacattcatttaaagatttctgtttggtggaagacaatcgattccctttcaagtggcatatgactattcatatggatttttcttgtttcatttctaattttacttagttgagtcttgtctctctttcttactgtagctaagagtttatcctttatcttttcagagaaaccaaatcttgtttcattgattttatttttttccttttattcatttctgctctaatctttcttattttctttcttctgctaaatttgggcttagttttttttctttttcttttagttgctcaagatgtagagttaacttgtttattttaaatctttcttcttttgtatagtaggtgtttatcactatcaactttcctcttagtactgcttttgctccattcagtaagttttaaaatgttctgtttccatttttctttgtcttaagatatttttaaatttatctttcaattccgtctttgacttcttggttgtttgagagcatatggaatacttttcacatatctgtgaatttatccagtttttcttttgttattgattactaattgatacttggtatgatttcagtcttctctaatgtattaagacttgctttgtgatgaaatatgtaacctatcctggagagtaatctgtgcacacttaagaagaatatgtattctactgctgttgggtggcatgttctgcatatgtctgatgtatccatttgttctacagttttgttcaaatctgttgtttacttattgactttctgtctggatgttgcatccattattgaaggagtactgaagtctcctactactattgaaatgctttctatttctctcttcaggtctgtcaatgtttgtttcatatatttaggcgctctgatgttgggtacatatatagctattatttttatatgtctttgtaatgaaatgaccttttgtcattatataatagccttctttgtctcttttaacaatttttaactaaaagtctgtattatctgatataaataagtgtccctgtaaaacaggaaattgtggacacagagaaatcagcagatgaagattggaggtatgcagccacaaaccaacaagctataataggagcctgaaatagatctttccctggaacctatttcggccctgagaacaccatgatattgtacttctagttttcagaattgtgagacaatacatttctattgctgaagccattcattttctgttaccttgttatggcaggcttggtaagctaaaacagagatgaaagccatgttcaaatctgtttctttaagaataaattgtgatcaaagctggagagaaagtgagaaagtccaatgaaggaaagatacagaacttgatttcccaagatggaggggcaatggaaaggcactggcggatattatcaacctccttttttcctacaggtaaactctcaaggataaaatataactgatcttgtttccatggtttccccccagccagcatgctaaatgcaatcttctcagattggtattcttaaactgccagctagtcaatttacttatgaagtttattcccacactgttactttattcatctatcttttcttctaaattttgtttttttcctattcttactgaaaacagttctctgcaatagagaaagcatatttatgtgcagatatgaaatgtctctgagttattcagtgacattaaaaagaaagatataaacaattactgacatctggatcccttagaaaaaaattttttttaatgaggctgaactcattttggaatttcttagtattctatgacgtggttcaatgttaaggaaaattaatctgggatcaggctaatggtatgaacaaaagtacgaagggctaaatggttatgctatacgcaggtagcatataaaatggggtaaggaaatcagatttattcacattgaagagtaattacaaataaaatttggtggagatagtggagccagcgtaagtaggactcttagccacttgtcatgaaaatgagagacttttgttgctagccaggtaaatctggaccttacatgagagataattgaaggaggagatttctctttctccttgtcgtgtgaggtcttaaattaaaaactttgttcagagaaatgggtggtacaaacaaacaatgaattaggctataactaggaccatgggaatcatcaattcatcagtttgtaagtcattcaaaagtttagctctgaagtagagaaacatcagtatttatgcaggcatgaatcaacacacacacacacgcacacacatgcacacacacacagcctgattctttgtcacatgttcagatctagaggagtatctatactctgtattatttcttattctactagatttatttggttcagagcttctatgttgtgtttaatgtgttgtcactcatagtttaaaaaacatgaattaagttataaatgaaagtgagaaaagaagtggtaattagaatacagagtttgatgaatttgatgaaactgtgggaagaagaaaacagaatttataaaagatgatatatggtgatgtaccttgaagtctctacactactatggcactatagcacataattagtgaaaatgttatattctctcaggagatgtcacctgtataaaataatgtaaagaatacaaagatagtctggctcaaaagttccttagagtctttctatgacgtgtttgcaaggtgaggtcttaggaatatacttctgacagatttatattggtcaaattcactatcaacagggctacattatttttaaataatcgttttccaccacaacaaaaatttacacgcaataataattaacaactatatatcaaaaagagacatggagagcaaatcagcatatcaggattttactcacagtttagaggtgttgtcctcaacaatttttcctaatgatcttgctttcttcttttgtgctcttgaaattttgtaaggtaagtttcccctttatttcacttgattactttacccaagcaatcaaggcactctcgtcactttaatgaggagtataatgctcagactgaaacaagtcccctgccactgatttgcaatgacaaaacaaaagactaagaaaaagatctgatcctgtattaaacaaatattaaacgaggaattgtttgttttactatttaaactaccattatcgaaattcagtactagtaacaacttgcaaaagtaaaggcagtattgatttttcacctaagggtcttatatattcatgaggaaacttagaaaatcaggaagttaaggaacaatgtggacaacaaaagaaaacttactaaaagtataggagtgtttgaaataaatacctattcataacttcatcctttaggctgaagttttaggctgatcttaacctaattctgtgtgtttctccctttttaatatcccctaaatatactctgatttattatgccagaatgtcagcagcgtgctgtaggagtggcaaaagcagagaaagggattaatctagactggcttaaggattgcggtcaacaatggttgaattgatggagtttagagctaggctctggggatgaaaggcacaaggagcgaaagttgaaaaatgggaagaagggaaagaaaagtgatttggatcctctataaatttgatgagcaaattttaattaagaataaaagttatggttaactatttaaagtataagagccaggatggttgagggtgataatatgatacaggtcatggccataggtcaatggctaaagatcattgtggatgagttgtaagggtaaaaacaaagaaaaccctgagtgctctatggattgttcacatgcttgctaaacacagtgagaatatggataagattactggcagagaagaaagtagtatcagacacccagttctctgtagtttgttcgggattgatttggggtgtggttataagatcaaggaagaaaggtaaataatgatataacgagatggctgtcagtttagtaacttggaagtggcaaattatgcccaaacatctggtctgtagggcacatggagattctgagaaggggaagctccccatctgctgggttttacattgttgagatatagtatttgtaatctttcgtagaaataaagagctctccataaatacatgtaaacggggaagagattgtcatggctttaaatgataggaatatgattccaaagaaaaaaggtaaaaatacttagaatcaagataaaggaaaaattaaagagaaatgtatcagaatccaggagatgataggtgctgaaactgggatttttcattttgcattactaaccatggaaagtggtatttgatcagtgtattttagattcttcatagcaaatttctctttctcccctatctttttttttttttaacaaaatgggctagtagttcctagtctcattgctttaataatttaattactttaatgatctgagaaagactgtggaggctcacagcagctaaatttaaaaaggtatttaaatgtaaaatattgaatgtaattttacaaatttctgaagtatatctttgccccacacattctgaaaaaattcatgctctagatctgtatcattcatttatgtttctacatgtagtgcctacacattatgtggtttaattaatgtgttattcaagaacaaagcaacaacttagcatttcaaccaggcatggttctagtaccagatttttcatttacacaaatatgtgataatatatttgtattactgagataattttttgtatttgtatttttatagaagatatataaatgcattctcatacatgacataaatacttatggaggtaggtctatagattctatctgctatagatttagcacgtgctaaatctgtagatatagatttagcaggtgctaaatctgtagacatagatttagcaggtgcaagtgcagttttctcacatggatatattttgtagtggtgaagtctgggcttttagtgcatccatttccccagtaatgaacattgtacccaatatataaattttcttttttctttttttcttttgtattttatttatttatttatctatttatttttgagatggagtctcactctgtcacccaggctggagtacagtggtgcgatcttggttcactgcaacctccgtcccccgagttcaagcaattttccctgcctcagcctcctgagtagctgggattacaggcgcccgctaccacacccagccaattttcgtatttttagtagagacaggtttttaccatgttggccaggctggtctcaaactcctgacctcaggtgatccacctgcctcggcctcccaaagtgctgggattacaggcatgagccactgtgtccagccccaataatgtcagttttcaactgacacccctctcctgtcctcccattttttttggaatatctaaagtctattattcctttctgtgtgtccacaggtacccattgtttagctcctacttataagtgagaacaagcagtatttgactttctgattctgaattattttacttaagataatagtctccagcttcatcctcattacatcaaaagacatgttttcattctttttatggtggcattgtattccgtggcatatatatacaccacattttcttatttaatcatccattgatggacatttaggttgattttatgacttttgctatgataaacacacaagtgcaggtgtgtatttttgatatagtggtttatagaggaactctgagtagttacccagtagtgcaattgctggatctaatggtagctctatttttagtcatttcagaaatattcatactgttttccatagaaattgtactaatttatgttattcttctcaggccacagtggaatgaaactagaaattgacaccaagaggaactctcaaaactataaaagtacatggaaattaaacaaactgctcctaaataatctttgggcaaaggaaattaaggcagaaactagtttttttgaaacaaatgaaaataccaacactacataccaaaacttctagtatgcagcaagaacattgctgagaagaaagtttatagcattaaatacccacatcaaaaagatagaaagatctcaaattaacaaccaaatgttgttgcaactaaaggaaggagaaaaacaagaacaaaccaattgcagtactaacataatttgcctttagtattctccaactggtattttccctgctggtttgattttatttccattttacacgatcagaggctttgaaaaatatttttcttaggagcagaatcaaatataaacaacttcaagtaacatctgtcaaaccaaggtcctctcctgccaattccactattgtttattgttttattgaacaaatgtattcactgcagcaggtacaactatttttggacaattgatgctttaacactttgcagtttgacaggatgagatgaagataagtaatgattttttttgtgtggaagtatattgaaggaccctgaaaactgtatggatttgagtatctcctatataggagatattactcaggacagatacatagctgttctcagtaatataactaaacaatttaccatttgaaatgaaaaggagtgactatggttatttatccaaagttcatatttataaatccagatttcttcatcaaaacatgatatacgtttgcctttccatgaagacccttttgttttatatatttattggggaaatgttgatacatatgcatatttttagaaaacagcatagtgaatccatgtgtccgtcacctaggttcagtcattaccaacctgtggccacttgttattcttttgtacacccacaacctggctgcctcaccaatagtcaggagtaaaccccaacccaaagcagtgtattgagtcatgtcttgatccaaacgctaatccattttcacccataccctgccctttctcctctaccctggcctgctcataatgccacctgagtctctgcccttctttttattttttcttctagttgtactgctctaatagcctgagtatgccacaagacagaccattaaagtcagtgctgcatacagtcaactcaaagggaggagatagaccagctgtgcctcctgtccgcccctcctttgctgtcacccatagattcatagtcgtggctccataaaggctataggagaacacctggtgcatgtgaagatcacccttctgctgttgtggctgcaggtgtttttgtttctttctggatggccccattaggcactttcaacaccacagccccccagaagtggtgatacttctaaaggtaactggcacttgtggagtcatggaaaccccaggttggttctcctatagtctgaaatttggggtccagagacacactgtccaaatcaaggtcaagaagtctttaacttctaaacacctccaagtgttcacctacacagagcagggtactctccttgaggtttttgtccagaatgactgctgctatcatggttacatggaagggaaccccgaaaccctggttgctcttagcaaagcccttgtattgagataaaggtatttgataaaaaggtaaatgtcattgtttatgaaattaagcccaaaagactttctaccacatttgaacatctggtatgttcccacccatgaaatgcggattaacagaaggagaaatagcaagaccaagtttcaagagagtgataatttccctttcatgcaaagtggatataagggctggtggagtcacaaatggatccttgaactggcagtggtggtagactataaacaattcttctatcagcaatgtaatatctgaaaagttcaggaggaagtagtcatggttgtccatgaaataagtgcttatttaaccacattggacattgatgtggttttacttggaactgaggtctggaatgccacccctgtctctgcagaaaaaaatccatttctgggacaattttgagaattaaaaaaacagctttaattcttgcatacaccataatgctgcacatgtttttgtaagacacagataccctaaatatcttggcttagatttattatgttggaacaatatgcagtcttcctcttaattgtggaattagtagtttcataggtgacacattttcttttttttgcattgattgtgttacatgcacttggttataatttgggaatggagtacaataacaaaaccaaagtccatgaggacaaaaaatgatacataatgtttgaaatagtaacatatgaaagtaggtatagcagttgcagttacagttatgctaagttagtggccaccactgttaaaaaaaaattaaagaggtacttatacaattcaccaaatcctgaggtcatcttcacaaagccatgctgtatgaatggtgtggttgaagaaaatgaggattatgactgtggttctttacagttgtgtaaaaaagattcacgtggtttggcgaactgcactctgaaacctggggctgcttgtgctttggggcttcgttgcagttcatcccatcaggtaaggtgtgcagagaacaggacaatggatgtgatcttccagagcagtgaaacagaacttgcataattgtccagaagatgtgtatgtgcaggacagggttccttgcgtgatcggaggctactataaaaaagagatgcaatatccatgataaatggagcagacaaacttttggcaaaaggtcaagagtgcaaagaatttttgcaaagaatagcaaaaatttacaatttcagaacataaactcaatccttaatgaaatttccccatgttaattacgtgtcctggaagtagaaatgttagtgtctatttagcatatatgccagagaccattgaaagaaaatcccagagatctattaaaggatcataaacattagccattaaataaagggcatttctattacatctctgcttttcattattttaagcatattttctgatttactttccatggaattagtctccttgtgtatcccaagcaaaggcacagctcatgagtgtcagtgacatgtgttcatgtgtgcatgtgtgcctgtgtatgtgagtgtgcctgtgtgtgtgtatgcgtgtgtgttgctatctctcaattccaactttcttcctctatttactctgctttgtcacagggaaaatgggaaattaaaaatcacatatcttctttgtcagtcctccccttattagtatctgccaacgaatggagctagagggagactggaaagctgagagaactgtttgatggatgtttatgtccatgtttcctcagtaacagctttcaccttgacagcatcagtagctttcagtctgcatgttattaatattgttagaagaaaaactttgggaaaattaaattcagtagagtttgtttacataaagtgtagctcataaattgggcagcactcagaaacagaagttcaaagagctccactcagcagtgggggcaggtagtacctatagacagaaaattaacatgatgtaccataacaacttgattgatctcagctgggcattggccttatttgggcatgagacgatgagacagttgccatatatggacatgttctgatcggttggctgctgtattagtccattttcacactgctataaagatactacccaagactgggtaatttataaagcaaagaggtttaattgactcacatttctgcatggctggggaggcctcaggaaacttacaatcatggtagacaggaagcaaggtacatcttacatgatggcaggtgagagagtgtgagtatgtgtgaagaaggcactgtcaaagacttataaaaccaccagatcttgttagaactcactcactatcatgagaacagcacgggagaaaccacccccatgatccaatcacctccctccctcaacacatggggattacaggtcccttcctctacatgtggggaattaaggattacaatttgagatgagatctgggtgaggtcccagagtcaaaccatatcagccacgtatgattaattaaagctcagctgctgtaattgactgggacttagatatttgttataagattatactcttaagttaggctgcagtttgtttatacactaagttaggctgcagttttctacatagggagttaaagtagggaggcagctttaggaaaattttaattaaatttaatgctatatatatttagtaacttctggatccaacagtattttcattcccagagataccagcacagctaccaagcaacttaccttcagaattctgagtcctaggtcattgagccctccaccaaattccaaaggtttcagcagcaggttggctctgctctctcctcagtggttggagccctagaacaacaagagctattccaactctgtaggttccaggaaccccaaccccttccctttgatctctacttctagtagtgatagctacatcttgttaatgcttgtgattatctcagggtgtggtttctcattttgtgagaactctaagtgacatagtacctacctaggtacaatggaggacccaggaagaagctagacaacagaaggtttttgatatggtttggctgtgtctccacccaaatctcatcttgaattgtagctcccacaatttccatgtgtcatgggagggacctaatggtaggtaattgaatcatgggggtgagtttttcctgtagtgttctcatgatagtgaataagtctcactagatctgacagtttgataaaggggagtttccctgtacatgctctctcttgcctgctgccatataagatgtgactttgctcctcatttgccttctgccatgattgtgaggcctccctagccatgtagaactgtgagtccattaaaccattttcctttataaattacctagtcttgggtatgtccttattaccagcatgagaacagactaagacagttctgaacttttcttagtaccacctttgaccattttggggaaatgatttaaagttagatagaatttcttcaaaatctgaaatgagaagatgataacatcgctaaacttctttgtaatattgcttataaaataggataaagaagatacttagaattctatgtaggatgtatgaaatcttggtttctttgggaaaagaaaagtctggaaaatcccaattaaccaatcatattttaaggctgtcagaggactgtgtaagcaatgaggactaagtgaatgaaaatgttaggcatggaatgcaattctgaaataagttaaatttgcagccatgtttccctctggagcacttgcagatgctgaatgtgaattgaggattaggcttgacccagttaggagacctctgctgagaaaaagagaaaccaccaatcctcttagttactacaccagattcataaattagacattttggagccttcaattcataatgaatttcccctaaatcacatttgctatatttgaagccttcgtgggatgctggtgagttaatttgaaatttcaaaaaagaatagtttcctgaaatcatgtcatattttggacattagtcatggtaatacagggcttgtctcaagcacaagtgtgtctcttcctaagatatttatttgattttgaacttgcatgtggcaagaggctggagagctggcttctggacccttaaatgatggcgattaatccccataatctttcagagctgaggaaatagagccacataaactcccaattgaaagtctagcaggctcagacctgagcaatataaacaaatgagaattagtccaagatttaccaaaaactcctgattcatttaggtaatcaagtcctcagcctatctttctaacagaagaaagaggaacaaatctttagtggagccacctggagctcctatggttgctttttacataatgactagcatacaataaaatatttccatacatgctaagagtaaaaaaaatcatgaccttgtattagataataaacaaagcagaagaaaataaaggaaagaaacagaaggagaaactataagtgtggtcaagataatccaaacagtggaccaagagtacatttaaaaaatgactatgattaatgtttcaaagaaggagaaaaatgtataaaatataagaaagaatataaaatatctctttacattgaattggacattatcaagtaaatattttagaactaaaattacagtatattataagaactcagtagatgggttaaacagtagactggatcagattacagaatcactcaactgaaagacaagtaggtcaatggaaaaattcctacactgaagcacacaaaaaaagcataaaagtaagaaagtaagaggtgtacagaatatacaaaaagttcccacattcataatattggagttccagagaaagcataaagagataattaaatagagataatattcaaagagctgtttttaaaaaatcttttaaaggaaagaaaggtttcaacccactgcttcaaaccaggtcacatacttctcaggggcattaataatatttttttcttgtttattttcttcagagagatttctgcttgctaataatctgtcttcaagtttgtttattctttctttcttctgtttgctcaaatcttctgtttatttcctctataaaattatttattttaattatcatactttttaccttaaaaacttaaaattgattattttatataatttatagctttttttttttttttttaagatagagtctcactcggtcacccaggctggagtgcagtggtgcgatctcagctcactgcaccctccacctcccggtttcaagccattctcctgcctccgcctcctgagtacttgggattacaggcacccaccaacatgcccggctaatttttgtattttagtagagacggggtttcaccatgttggtcaggctggtctcaaactcctgacctcgtgatccacctgcctcggtctcccaaagtgctgggattacgggggtgagccaccgcacccggccaatttctacctctttactgatattcagagttgctttttgtatagccagtgtttgatcagaaattgtgcttaatccagtagactcagtgattctcctatactttgctaacagatttgactgtggcctgaagaattcttcaagtctgtaatatttcatgctctgattgtaatgggtgcaccgtggcacatgtgcacagccctctgacattctattatgactgtcttcccaggagaaatctttctggctgtctctttaccttgttctctcttttaaacttctggttaggttgccattttgcttattgctgtgaagttcatgaagttactggccctttattaattgcttgccacccaacctccactattttctttttgttttttattattatactttaagttttagggtacatgtgcacaatgtgcaggttagttacatatgtatacatgtgccatgctggtgtgctgcacccattaactcatcatttagtattaggtatatctcctaatcctatccctccccccttcccccaccccacaacagtccccagagtgtgatgttccccttcctgtgtccatgtgttctcattgttcaattcccacctatgagtgagaacatgcggtgtttggttttttgtccttgtgatagtttactgagaatgatgatttccaatttcatccatgtccccacaaaggacatgaacccatcatttttatggctgcatagtattccatggtgtatatgtgccacattttcttaatccagtctatcattgttggacatttggattggttccaagtctttgctattgtgaatggaacctccactattttcaacaatgtccttattcatgaacttctgcattttctagtaaataaggtcagtctcctcagtcagagctaagacctcttggtccttctgagtagaacatctgtgacactatacaggagttggaactgggaacagtgaaccactctactggagtgatatctcctttctacaagagggtatggaatgaagacagtagaccgtggtcttcttggcttgctcctcctggcatagaacctctgatctataagcacactggggcaaggaaaacagaggactcagtaatctaggcgtgttgtgcctggggaagaactctcaccctatgagtggaagctgggtggttgacctggttcatggtaacacaaaatatagtttttatgacaggaagctggagatggaattaggtaagtctgatatttgttcttattcgggtgaatccatcgcactagcctcagagcttggggttgagtgaaccctctttttcctggtctcatctgtacagaatatagacagtatcatggataaaggtcaagtgccacagatttttttctcttctaccaagatttagaagatttgttccggtaaatatttctccaattgttgtatgatcttaggacaatcgtcagcaacattaaacatttttaaatttttcatcatttgaattgttgttgtgtggagaaaagggtctgtcaagctcttcatatagttactctgaaacttccatccccatggcattttgaagaaaaagaaaaatgtggtattttgaaggagaagaaaaacactatcagatattcaagcctattataaagctgtggaaattaaaatagatactaagcagtgaagtagaatagagaggccaaatcaccttttcagtagcttttgttgggtccattgatacccatgtaaaaatgatgtatctttatcactacctcaaactgtaccctaaagccaatttcagattgatttaagatgtcaatgtcaaagagatatcaatagatctattaaaggaaaacacagaccgatgacttgtgaccacagaatcagcaaacttactttaaaaattgaataagttaaaaatatttgatatataagacattaaaaataagagtgtctactcttccaaaaacaccattaaaagaatgaaaacacaaatcctttatttatttggagaatatatttgcaaaatgtatctatgggaaaagattcatatacagtgcgaaatatataggacttgctgtagaatgaatgtttgtgttctccccaaattaatatactgaaaccctaatcctaaatgtgatggtattaggagacatggcctttgggagatgattaggtcatgagggtggaatcctcatgagactgggggccttaagaaagagaccctggagatttccctgacttccttctgctacataggacacagctaggagttggatatatacgaaccaggacttgggcctgcaccaggcactaaatctgccagtgtcctgatcctcaatttctcagcctccagaactgagagagatatacttcgattgtttataaaccactcagtttatggtattttgcaatagcagccctgaactgactaagacaactccttcaaaatattaaggttagagaaagacaaacctacagaaaattggacaaagaaatctgtcatttctccaaagagagtatctagtggcccatgggaatatgaaaaggcaatcaacttttttttttttttttttttttttgagacggagtctcgctctgtcgcccaggctggagtgcagtggcgggatctcggctcactgcaagctccgcctcccgggttcacgccattctcctgcctcagcctcccgagtagctgggactacaggcgcccacccccacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggccggcaatcaactttttaattatcagagaaatggaaatttaatctgcaatttgataatattttccaaacagtatggctaaaattaaaattttggaatgtatcaaaggttagcaaggatatggattaattagaactctattatattggtgttagttgtggaaattggtcgaaaaacattggataattgctttgatctgtctgctaaacaggagcatgtcatgtattctgatgaattgcaatctgagttataggctagacataagtgcctccatatttttactgagggacatgaactaatatgttcatagaaatatgcatcatggtagctgaaagctggcacccaccatataaatgctcatcagtgttagcctagatcaataacttacagcatattcacatgctgaaatagtataaaggaataagaaagaatgttctacaaatgtttgctacaacatggataaacttaccaaaaaatgaatgaaataaatcagctacaaaatagtacatacatattacattattccacttatataaagcaaaaaacaggtgaaagtaatctatgctgttaaaactgaggatagaatttattcttgcagaggggttaaaaaggggaagcaacacaaagtatacatattttatttacatgcaatttttaataatataaaacacagaaagaattaggtaacaaaaaatgtaagtttcaaaaacaagaccttcagaaaccttttcctatgtacttctcagccaaccttaactacattagcttttttccttatttgggtgtggaaacaagtcatgccttctgaaatatacttctaaaattcagtacccaaatatatgtttaattatggtaggtggagatgtatctgttttagtccatagcatatttttaatataaaatgagaggtttacgaaataaaactaacaatctaagtaaaaagttgagtcaggaaaattactgtacaaaacgaaagtcatctaattatagatagataggaaactatactacagagtgcacaggaaacagattaaatatgtaaaaacagcttgctcatcattaattaatagcaccagtattttgaaataataggaaatattgacttgggaaagaaatgtagcataaaacacaattcccttagttatttttaaatcatcttgatttaaatgcaggcaagcagtgtatattacctctccaatttatgtatcatgttggctctaagttcaataacatttaaaaaattattttaaaacagttttggtgaggtataaagtccatactttgtacagatttcttttttttccccacagttctttttctgtagtagagtcccatctgggagaccacattacaggtggtcgtgtcttcttaggctcttcttggctgtgactattttgcaggctttcctgacttttgatggccttgatataattgaggaatgttgctcaggtgttttgtaaaagtttctctaattgggggttttctttttgaggttaaacagagttttgagtatgaaggaggaaaatgacagaagtaaagtaccgtttttatcacaccatgtctagggtgcatgatgtcaacatgacatatctatgatgaggctagcctttgtcacttggcttaggtagtctttctcagatttctctactgtaatgtgactctcccttcctcatttccatactgtcaccattggaaataagactgtgtatgtcccaaagttaaggggtgggcagttgagcgctgatccaaacatttttatgcaggttttgtgtagacatgtttacaattccactgtataaatacatagaaagatttctggatctcgtagtaagactatatctagctttataagaaagtgccaaactgtctttgaaaatggttggactattttgcattcatagcagcaatgaaaaagagttcttgctctgcattctctgcacaatttggattttatagttttgaggttttagccagtttaacaattgtatagtggtttctcatttattgtttttaattttcatttccccagtaacaaatatatgcatttttttcatattttatttatagttcatttatcttctttggtgaggtgtcatctgtttggatctatgttttctttctaattggggtttttctttcttattactgagttgtaagagctctttgtatagcttcataatcagtcttttaccaaatacttgatttacaaaagtttttacagtttgaaacttgtatttcttaataatacggtcttagaacaaaaatgttttaatttaaagtttaacaatgtttctattcatagattatattttttgtattgaatctaagaattcattaccagtcccatcttctgtagattttttcccatgttttcaccaaaaagtgttataatttttcattttacattgatgtctatgactcattttgagatgattgtataagaatttattttagattcttttcatatagacatccaattgttccagcaaaaattttagccattctccatcaaagtgtcattttgcctttgtcaaaattggttgaatatatttatatggattcatctctctttctgatctctctattcgatttcactgatcaatgtatttattctctcaccagaatccttctgtcttgactaaagtagctttatgataatcggaaaattgggtcatgtgggtcttctatttttgttctttttcagaattgtgttggctatttcaggttctttgcttctgtatccagctaagaaccaggatgtcagtatctctaaaaaccttattgagattttgactgtgattgtactgaatctacagatcactctgacaaattaacttcttaataataagtcttctgattcatgaacatagaataactttccatttatttaggtctttaattttttcaatcagtgttttatatctttccatatataaatcctgtacacttgtacatattttggaagatttttgcccaagtacttccagtttttataaaatttaaaattgcattaaacaactccacttttacattgttgatatataaataaaaaattaacttttataaattaatattgtttcatatgacctagttatgctggcttactagttctaggattttttaggatactttgaaggtaattacatagacatcatgtcatctgcaaattcacagatttatttttttccttccaatatatagaccttatatcttattggcctggcttattgcacaagctaagatgtccaatataatgttgaagaaggatctcagaagaggatattttgcccagttcatgatgttagagagaaagtatttcatctttaaccattaaatatagtggtagctataaatttttcatatataccatttattacattaaggaatttacttgtttttcttttgttcttatatttttgagaattttgtatttttaaaggatgctaatattgtctattttttctacatttacagaaatagccatgcagttattctgaactacaaagactggtttacatatgtttaatcagtctgcatttttgtaatgaattcccctattaaaactacctgtgattgtgttttatttttagaagtgtttaactctgaattgtatagcttttatagatatggaactattccagttatacatttttttcttaagcaagtttagcagtttgtgtcttctgtgaaatttgtacgatctaagtaataaaattcatggcatatagtttttcaaagtattcctttgttatccttttagtgtctgttgaatcagcactaatgaaacctctttcatgactgatgttgtcaatttgtgtcctttccatttttttcccaattagcctgactagaagtttcttaatattattaatttttttttgaaaaatcagttttgggttttcataattttttctatttttaaaaatttgaattccttttatttctgctatattttgtattatttttatggttaatttaactttaatatgctattacttctgcacttttctaaggtagaatttaggaagttattaattgaattaagtaattaattctaatttaagtttttaagtcattaattttactttattttcttttttatatgtgcacttactggtataaatttccctcataggtactgctcttgctacatcaaccaaattctcatgttattttcattctcatttagttcaaaatatttttaaatttctcttgaggcttctttgactcatgtgttatttggaagtgtgttgattactttccaactatttggatatttctagtcatttttttattattcttttcaagattaattccattgcatccagagaaaaatatgttgcatgatttctcttcttttaaattttttcagatgtattttatggcacttaattgtgatctaccttggtgaatatcaacgaaaaattgagaaatatgtatactactgttttgggatgggatgttctatagatgttatttagatcaaatggattatttattttcaggtatctatatccttgttggttttctgcctgctttacctatcaattacggatgtgagacaggggaagggatattaagttctacaattatgattatggatttgtcactttcaaatttcattttcatcagctttagcctcaagtagtttgaagctttgttgttaggtacatacaagctagaattgtattatttttggagaactgacttctttatcattatgcagtggacctctttatccatgataattttctttcttcaaaatgttactttatctaaaatacatttgttacagctttcttttgcttatcgttagcatggtaactttctccatgcttttaacttgaaactgtaagaatttttatatttaaagtgggtttattgctgacagatatagttggggcttgtatttttatccagtctgactataactataattgttagaacactcatattcaaagtgattattgatatagttggattgcaatgtactacacttatttataatatttttctattcattaaacttgttctttgttacttgttttccagctcttttctaccttgtctggtttttaattaggaattttatgtgattccattttatttggtatatcagttatacttttttttttacattcttttgatgaaacttggtttgcattacatgttgttaaataatcttagttcatcttgaaataacacataatgtagagatcatatagtagtgtgtttcatattgtcccttctgtcttctgattcatgaacatagaatacctttccatttatttaggattaacaattaacaattgttaatcctaaataacaatttaggattgttctcttctgatattgttttcattaccttagttatccatattctataatcatccaatatattgttatcattgctttaagcaaacagatattaactcaattaagaaaaataaaaagagatttttactttactttaaatcattctttctttgatattctttttcatggaaattcaggattctgacttatcccattctccttcctcctgaaaaactttaagtgtttcctgcatgggaggtctgttgccaataaatatcctcagtttgggcttaagaatgacattatttatcattcatttctaaagtataatatgtagacatgaaattctagattggtaggatttatttttcaatactttaaagatttgtctctattatcttcttgtttccattatttcagtaaagaattggctgtcattcttatcctaagggttctgtaagtgcctctcatccagcagcttccttccagactttctatttgtctttttttcccctccacagttttagtacaatgtttttatgtggtgtgtgtgtgtgtgtgtgtgtgtgtgtgtgtgtgtgtgtttaatctttaccatagttggtgttttctgagcatcctgatctgtggattaatttcgtgtcctcaattttggtcattattactttctagtttctttccctctagtattcccattacatatatgttactcttttgatattgttccacaattcctgagtgttcttgaatgtttatttctttatcttttttttttctttttgtgttacagctgagaagttactatagacttgtcttcaaggtcagttattctttcctcacttgagtttactgactacctcttcaaaagcattaatttctgctaatatgttttaggctttaaaaacatttaagaaaatttctaccttttaaaaaactcctttttgtttccagtgtgtatacagtttccatctgtatttccagaactagtttgtgtagataccaaaccagatttttgttttacgaaattcaccagtgaaacaatattgtgctgagtttctctgtagaaaggttgttgacaatgaagccaatatagaactatttgtattttctgtttcatcttgtgtcactttgttaatgtgtttttttaaaaatttattaattatacttaagttatcataaaggtgtcataaacatgtttatactattttttgagctattatatgtctacagaatttacaggaataatctctctgctgttcttgatattgatcatttccattcacttagttttttcttgattgatccacctaggtttttacccattttcctgctgtttgaaatgataaacttattctgttcctttttttctgtatcctttagtttgaaatattcagtaacttatattgtgattacttctttatgcatggattatttagaagttgtttagtttacaaattattgcatctcataatatattattattatgtatttaaacattaattttattgttatcaatcaatatagtaagtgtgatttctttttttaagtatttagagttgtttcttaatgctgtacatgatctcacactgagcatgtaccatgtgccatgagttttctgcctctgttaggtgtattgtttcaagtatacatttggtcatactgcatgacagaggttttaagaatacctatttctttaataattttttctctagttgttctatgtggtatttcattatatggctgtgccaagttttggttatccatttaccagttgataaacaatggattattttcaggttttggctcttatgtaaaatctctctataatcaccaagtacatatctttgtgtggttatatgtttttatttctcttaggtcacatggaaaatttatgttcaaatttttataaaaacaagcacactatttctgaaattgtctacaacatattacatttccacaagcaacatgtaataccttgctttttcacatcttcatcaaaagtcagtattgtctttattttacaatagttttccttgtacatatagtggtatttctttctggtttaaatttacatttccctaatgactaataatgttgaaaactttttcataagcctttaagccactcatagatctttactgaatgtctacacaaatcttttgtccattttatgggttttggcttcctattaacaagttataagaatttattagatattctgaatacaagtcctttacagatatattatttgtaagtattttcttccagtctgtaggtacacacacacacacacacacacacacacacttcatatataaatatcttaagaagagaaaattgattgaaataaatacctagttaaaatataagagctaaggaatctctgctcatagcaggtagaagaaaattgctgcagagataattcttcctaaaataaataaccaaaaaaaaaaatcaaattggctcaaaactaacaatccacaaatttgtagactaaattgaggcctgggggagtcagcaggatgactaattaaaaatgaattcaataaagctgtgaaaattggaataagcatctgtcttgaatagactacacatttaaatatatgaatcaggaggcttgaaaatgatgttattatttcatttgtttttatctatgttcattaaagtacgctgtgctgataatatatttttaaattatctttttatttcaaaattgtcattttataatcattttatacatgtcagtagatactttgtattttcttgttcatatatattttagattttaatcatgaaacattaacatttattaatataaaatagctactgaaaaaagatagaaaaatgagagacaaaataaagctaataaaacatatatgctagtagtgagggcatctttctcaaaattttgatatctgaaatgcctcaaataatatagccacattttcttgattatcagggaaatgtctgctatattgtataaattatgtattcaggaataagcatgaagtgattcaaaatggcatttcatttgaaatgtagtaagtcctcacctgatgtcattgatagtttcttgaaaactgcaaatttaagtgaaacgatatactgtgaaatgaaaccaattttacgataggctaattgatataaacaagagttaagttgctatggcatacagcacatcattttgcttaaagtcagagtttccaagaacctatcaacaacactaaatgaggacttactatagatgcgtcaaatatctggctcatctgatcatgaactatctaattagaaaagaaggaaaaaccacctctacttttctgacctagaataacttatattctattttgttaggaagatgagagaagaagaaagtatggatataaaacaagactgagctctgcttcccattagagtacaagaggatggtgtcatacacaattatatacatggaaaaatgattttatttttcctttgtgcctccctggtgaaagacatgcctgccttcactggaaatcaatattgtagttatcattggcttattgaacatgtcaatatgcaattgtcttgctttatccaaaaatctttaatcatttctaaattattagatgaaatacataaatacaagtcgattaagctatacagagaaataaatatgaaaaagttttatctatataagacctcaaaatttgataaagtgtaaattgccctgttttataattgcgtttatttaaagacctgctatttatatttttctccacacactttatgaaaagagcaaaaatcagatgtgcataccaagtgtgcaagttcagctcctaaaggtcaaagtttattcactatacaactttactaaaccttactcttctgcttttctatacacaatttccttggaaaatacccaaataagcaaatcatattttacctcatgcagtgattattagactatcatctttatcggtcacatcttagactatcatatttactggtcatgtctctccattttcaatactctgcaacaggaatcagatgttactgcctaactgaccttgtttcagaggcattttcattatgatatctcctatttagaaatattagattctcatctattttggttaggacaaagtaaacatgctttatatcagatcttaaaatgtattgaaatctagcctcacactacacagatattaatctgaaaaatagactttagcattcttctcatcatttcgtttgtacattaagtcattcctcttaccagaagctttcttcctttccctccttactggtatttaactatgattcattcttttaaaggctgctctagctgctctagcaaagttaagcacagatttttcccactccatgaagttttctggagctgcactgactgttgcttcctcaacccccgtacatgtctcattcagtaaaaatttcatctcattgaggtatatttacttgtatttttattttttccataaatttattctaaacctctaaataaatgtgctattttttgtggcttaaaggcactacctaggaaaatatacccatatataaatacctccaaaaccatattttttaaaagagggtgatgaacttatcttagcactgcagaatcactccatttgtaataccatgactttgtgttcacggtattcagtgctttacatatattggtggtaatactagtcatagtaataatgacaatagacaacacttatgtgtgttaaccactgttttgagcatgactcatgtattaactcttaattctcataaggtctctgttacacagttggaaacattgctgcacgtttatctaaggcaattagcccagaaaatctggctccagattacattcttaccacaatactgactctccataaagtgtaaacttgattgaattgattatttaaacatatatacaaatccattaagaactgaattgtatacgtcttaaaattcattgttccatatacataacaatgctttaaaatcagcagtgccaaatatgaaaaactattgtatattttcatgttaggtaaagctatgtttttcctttcttcacacacacacacacacacacacacacacacacacacacacacaatagataacgtgtttctcttttagaccaataataatgaaatacattatgaacactggacttcataaatggtaattgatttggcacatgatttattgccctctataacaaccttcccaaattttctgaacaaacagatcaacagaaagctctttcttcactcttgtttatctgtattatgaataggcttaaaatatcactttggaaacatcacttttaaataactttgttgttccatcaatttctgtccatgtaggagtaagaagaaacattaatcagaccttcactgggtctgctctctgctccatctaaagaagaaaaaaatggcttctctgaagattcaggcagcccattcatttctaataagtagagggctatgattggtttttcacatatgtctttagttacaattattaagaattatttttgggagagtaatgaagtcaccaatatggaagagtaagacatagcatattctatcccccacaataaaacaaataaagacatctaaccacaaacaaaatagtcctgggcgagccaaagaacccatttaaaaatatgcagcaatggtctcaaactcctgggcttgggcagtcctcctgccttgccctcctaaagtgttggggttgcaggtgtcagccactgtgcccagccatacagtttttaaaataacacatggtcttatatttgacataatatagcaaattaggctatctttacttttttctgtttcaaacaatgtttaataattatatttccttagataactgtttctgttatgaaaaaacctgaaaacaaaataattagtgtttctatttatattctaactgggaggcatttgggttatgggggtggatctctcatggcatgatgctgtcttctcaatagtaactgacttctcatgggatatggttgtttaaaagtgtgtgacaccccacctctgtagggagatgccctgaaactattgctacagaataaaagatgaaattctcctgattattgtaaatacaagattgcatgcaggattgtgtaaagacaatgccaggttggactgccagaacgagccaacagtgcgtgatgtgcttcctcctgcagagagcctatgaacggatgtgcagtcagggaggtttcacatcaccaagattcctatcccagaaaagcagatgtttatagctctaggaatggaatgtgacccttgtggagagcctataaacggacgcatggggggtgcctgtccatatggataagatagggctataaacaccctcatcttgccacggctcttctaggcctctttagggttaaggcatactcccttctgagaatttctggtctaacctgttgtctagcttcacgtcctgtttctatggattgtttgtaaccagcttttgctgcaactgttactgctgattaatatcttgctaatcataggctatggaaagattgtgtttctgttttaaggctctgttagaaattactgacgcacacactatattgtaaattcttatctctgtatactgtacttctacatacaaatgtactgtacttctacatacaaatgttatgttaaagaattactttatccccaagtgaccatctcacttcatcatcaaatgaccctaaatctctcactaacctacccctgccctcactaaacttaataataaatgctgatatatccagtgcattgttagcaccacaggaccagaaggcgatgaccccccctggacccagctttcactatcttgtgtgtgtctattatttctcaacctgctgatctgcctaggaacaaagagagagctccgttgtattgagggctgctggccagatcccgcaatacacctcctcattgcccctttgatgtatctgttcctgcttcaccttttgccatgagtaaaggctccctgaggccttctcagaagctgagaagatagcggtgccattcttttacaggttgcagaactgtgggccaattaaacctcttttctttgtaaattacccagcctcaggtatttccttatagcaatgcaagaacagcctaatacaaatacattgatttaattgaatgtgttaaattaaatggatggataaaagttaccaacatcagaagaagacaactttgctggattcttcaagaagtcaatgtcatgaggaaaaaaaagagagggggatgttatggtttgaatgtgtccccatatttcatgtgtaggaaacctaatccccaaatgcatatgttgattgtatttggaggtggggcctttgggaggtaattgggattagataaggttatcaggttgggatcaccaggatgggactggtagccttacacgaagaggaagagacctgagctagcacacacttgttttctcaccatgtgatgccttccaccatgttaggactgtgcaagaaggccttcaccagatgccagtgccacatccaatttcccagcctctagaattgcaagaaataaatttgtttctattataaaataaaataaaaatctgcagcaacaaagtggagcaaaaaacagaacatctacacagaatggatttttggtgataacagaataactgagatgctaggactaagctaggactaagctaggactaagctaggactagctagaataactgagatcgaggactaagaaaaaaagtggatgctatcagtactagtttatgcagggggaacagccatggagtgcagctgcctggtccatggatgacacgagcatcttttgccactgaggtaaccaacagtcattcctgtcaggaaacacagagaggagatgcagccgcaccccctgccctaataatcagctgctgttgtgatgctccaggactagagctacctcttcctacacctgtctgtgagacctgagccacagctgctctgcaagtgtccacacttcagacacctctctgtggctccacagctcacatttatgcctcatacacaggagccactgccatagcaagctagttcacatccttggcctgggattcaaagtttttctatacatatctgtgctctagatgccaattcagctgccaaagagagctcagctacacactcaatcccagagccagtggagctcttctcatgcctgtgctcctgtccttggctttctggttgtttcacaagctcaagcaccttgcacgattaccaatgcagtagagaagatggctgtgtcccaggcactggagccatagctactccagattccagagctgaagtccttacatgtgtgcctaggattcaggatttggcttggtggctgctccacagatggcaactgtcagatgccagtgttactgtcactgcaaacaagctcccaagttaccactggtgtcaagaaggatgcccttgacattgactttcccagtgaaagaaatagacattggaaggaccctaacagccattaccaatgattaccactgctgcaaatatctaaaatgttggcctctgaggatccctgcaatcttcatcacactgaccttagttgacagagctgaataaacatcatactgttgcactttcacatactcctatagcaggctctttgccatcaaaatcatcctgtgacatctagaagagatgattgcatcaccaactgcacagacatcaatataaaccaactggaaacatgaaaaccaggcagacatatcaccaaaacaacacaataattttctttcttttctttctttttttttttttgagatgcagtctcgctctgtcactggagtgcagtggcgtgatctcagctcactgcaacctctgcctctcaggttcaaatgattctcctgcctaaacctcctaagaagctgtgattacagatgcaagccaccagcctggttaatttttgtatttttagtagagacagagtttcaccatattggccaggctggtcttgaactcctggcctcaagtgatccgcctgccttggcctctcagagttctgggattacaggcatgagccaccgcacccagccgacacaataattttcaagaagctgatctcaaagaaagggaaatttacagaacgcctggcaaaaaattcaaataattgttttaaagaagctcagcaaacttcaagaaaatacagagaaaaaactcaatgaaaccagaaaaaaacataaataaacaaaataagaaatgtcacagagtttgaaattacaacaaaaaggactagaaaagctgaatctgaaaaatgcaatgaatgcagtaaaaaatgtaaaagagaacatgagcagaagaattaattaaatggtgaatctgtaaagttgaagacagtttccttgaaaatatacagaaaagagaaataagaataaaaatgaataaggaaagcccccaggatctatgggattgcaacaagagtgctagctttcacataacgggagttaaagaagtagaagaaagaggaaaaagagtgacagaaggcttatttaaagagacaataattgaaaaccttacaaatctggaaaaaagatataaatatttaggtacagaaattgacatttctcaaaagaaaacatataaatggccaacaaatataagaaaaaaaaatgctcagcatcaccagtcatcagggaaatgccaattaaaacttcaatgagataccattggacacctgtgagaatagctattatcaaaaagataatagataagtgttgacaaggatgtaaagaaaagggaatcttgctataatgttggtgggaatgtaaatttgtacaacctttatgaaaatcagcttgaagactcctcaaaaaattaaaaatagaattaccatatgatttagtaattcctcctctgagtatatatccaaaagaaaaaaatcaatttgtcaaagagatacctacactcccatgttcattgcagctttattcaaaataggcaagatacagaatcaatctatgttcataaacagatgaacggataaagaaattgtattgtacatacacaatgcaatagtaatcagacttaaaaatgaaggaagcctgtcatttgcaacaacacaaatgaacctgcaggacattaggtttagtgaaataagccaggcacagaaaggtaaatgatctcctttgtatgtggattctataaaacatgaactcagaagcatagagtagaatggtctttaccaggcgcaaaggtgggagacttggaaagacgttagtcaaagaatataaattttcattttgacaggaggaataaattcaagagatctattgtaaaacataattatagttaagaacaatgtattttataccaaaaatgataagtaggtaatacttatgttagttaacttgatttaaccaatccacaatgtgtatatatattaaaacatcttgttttattttgtaaatatatccactttttgtcattggaaataaatatgaaaagaaaaaatatttttgattttttgaaccatttttattgtatttacagatcttgtaagtatattgtacttacagaaatgtaagtattagtgattaaaattttcactggcaatatttaaagtgcaagatgtttagttctatataaatgtcctttaaaacacaattggtgaagatttctgaaaaagatttcattagtttttgatctctagctgtttacttcttgtagatcacagtttttccagtgttaattctagcttgttaattactatgaatgtttataattgtagccattttttcgaatcattttaccaaaggcggttattaccatcaatttaaaatacattaaatacaatatacctgcaaaagtacaattttattttctgcttcaactgaagttgagttcagatgtctaatgtcctttgactcagttgtaaagagattggtactataccatccacacaaaatgacagacgtcctcttcatattccatttcttgttagctaaataggtgcatctcaagtggatcaatttacactgtgatgtgctttctttgtctttaaattagcatatttgttgtagcttggtggttacggtgtttttgtttcttcttattattttatgacaagcatgttttaattattctagccctagacaataacactgatgtaagtgtcaggtccattgggattcttgttaacaaaaaatttagttggtcttgtcagcttttggcaatgactattttacaggtagagtactggtatatgtatctagaaagctcaagagaaggataagaccttcatagggtaacagatctgtaactagtttttaaaaaaatttttttattatactttaagttctagggtacatgtgcacaacgtgcaggtttgttacatatgtatacatgtgcggtgttggtttgctgcacccattaacttatcatttacattaggttttcctcctaatgctattactcccccatcccccccaccccatgacaggccctggtgtgtgatgttccctgccccttgtccaagtgttctcattgttcaattcccacctatgagtgagaatacatggtgtttggttttctgtccttgcaatagtttgctcagaatgataacatgcagtgtttagttttctgttcttgcaatagcttgctcagaatgatggtttccagcttcatgcatgtcgctacaaaggacatgaactcatcattttttatggctgcacagtataccatggtgtatatgtgccacattttcttaatccagtttatcactgatggacatttgtgttggttccaagtctttgctattgtgaatagtgcctcaataaacatatgtgtgcatgtgtctttaaagtagcatgatttatattcctttgggtatatacccagtaatgggatggctgggtcaaatggtatttctagttccagatccttgaggaaacaccacactgttttccacaaaggttgaaatagtttacagtctcaccaatagtgtaaaagtgttcctatttctccacatcctctccagcacctgttgtttcctgattttttaatgatctccattttaagtggtgtgagatggtatctcattgtggttttgatttgcatttctctgatgaccagtgatgatgagcatttttcatgtgtctgttggctgcatgaatgtcttcttttgaaaagtgtctgttcatatcctttgcccacgtttttatggggttgtttgattttttcttgtaaatttatttcagttctttgtagattctggatattagccctctgtcagatggctagattgcaaaaattttctcccattctgtaggttgcctgttcactttgatggtagtttctttttctgtgcagaagctctttagtttatttagatcccatttgccaattttggcttttgttgccattgcttttggggttttagtcatgaagtccttgcccatgcctatgtcctgaatggtatttcctaggttttcttctagggtttttatggttttaggtctaacactgaagtctttaatccatcttgaattaatttttgtgtaaggtgtaaggaagggatccagtttcagctttctacatatggctagccagttttcccggcaccatttattaaatagggaatcatttccccatatcttgtttttgtcaggtttgtcaaagatcagatggttgtagatgtgtggtgttatttctgagggctctgttctgtttcattggtctatatctctgttttggtaccagtactatgctgttttggttactgtagccttatagtatagtttgaagtcaggtaacatgatgcctccagcttttttgcttttgcttaggattgtcttggcaattcaggctcttttttggttccatatgaactttaaagtagtttttttccaattctgtgaagaaagtcattggtagcttgatggggatggcattgaatctataaattaccttgggcagtatggccattttcatgatattgattcttcctgtccatgagcatggaatgttcttccatttgtttgtgtcctcttttatttcgttgagcagtggtttgttgctctccttgaagaggtccttcacatccattgtaacttggattcttaggtattttattctctttgtagcaattgtgaatgggagttcactcatgatttgcctctctgtttgtctgatattggtgtataggaatgcttgtgatttttgcacattgattttgtaccctgaaactttgctgaagttgcttatctgcttaaggagattttggattgagacaatggggttttctaaatttataatcatgtcatctgcaaacagggacaatttgacttcctcatttcctaattgaatactctttatttctttatcttgtctgattgccctctccagaacttccaacgctatgttgaataggagtggtgagagaggccatcgccgtcttgtgcccgttttcaaagggaatgcttccagtttttgcccattcagtatgatactggctgtgggtttgtcatgaatagctcttattattttgagaaacgttccatcaatacctagtttattaagagtttttagcatgaagggatgttgaattttgtcaaaggccttttctgcatctattgagataatcatgtggtttttgtctttggttctgtttatgtgatggattacatttattgatttgcatacgttgaaccagccttgcaccccagggatgaagccaactttatcttggtggataagatttttgatgagctgctggattcggtttgccagtattttgttgaggatttttgcattgatgttcatcagggatattggtctaaaattctcttttttggttgtgtctctgcccagctttggtatcaggatgatgctggcctcataaaatgagttagggaggattccctctttttctattgattggaatagtttcagaaggaatggtaccagctcctctttgtacctctggtagaattcgactgtgaatccatctggtcctggacgttttttggttggtaggctcttaattattgcctcaatttcagagcctgttattgatctatttagggattcaacttcttcctggtttagtcttgggagggtgtatgtgtcgaggaatttatcaatttcttctagattttctagtttatttgcatagaggtgtttatagtattctctgatggtagtttgtattactgtgggatagatggtgatatgtcctttatcattttttattgcatctatttgattcttctctcttttcttctttattagtcttgctagtggtctatcaattttgtcgatcttttcaaaaaaccagctcctggattcattgattttttgaaggtttttttttcgtctctatttcgttcagttctgctctgatcttagttatttcttgccttctactagcttttgaatgtgtttgctcttgcttctctagttcttttaattgtgatgttagcatatcaattttagatctttcctgctttctcttgtgggcatttagtgctataaatttccctctacacactgctttgaatgtgtcccagagattctggtattttgtgtctttgttctcattgttttcaaagaacatctttatttctgacttcgttttgttatgcacccaatagtcattcaggagcgggttgttcagtttccatgtagttgtgcggttttgagtgagtttcttaatcttgagttctaatttgattgcactgtggtctgagagacagtttgttgtgatttctgttcttttacatttgctgaggagagctttacttccaactatgtggtcagttttggaataagtgcgatgtgctgctaagaagaatgtatattctgttgatttgaggtggagggttctgtagatgtctattaggtctgcttggtgcagagctgagttcaagtcctggatatccttgttaactttctgtctcattgatctgtctaatgttgacagtggggtgttaaaatctcccattattattgtgtgggagtctaagtctctttgcaggtctctaaggactcgctttatgaatctgggtgctcctgtattgggtgcatatatatttaggatagttagctcttcttgttgaattgatccctttaccattatgtaatggccttctttgtctcttttgatctttgttggtttaaagtgtgttttatcagagactaggattgcaacccctgcattttttttgctttccatttgcttggtagatcttcctccatccttttattttgagcctatgtgtgtctctgcacgtgagatgggtttcctgaatacagcacactgatgggtcttgactctttatccaatttgccagtctgtgtcttttaattggagcatttagtccatttacatttaaagttaatattgttatgtgtgaatttgatcctgtcattatgatgttagctggttattttgctcgttagttgatgcagtttcttcttagcctcgatggtctttacattttggcataattttgcagcggctagtaccggttgttcctttccatgtttagtgcttccttcaggagctcttttagggcaggcctggtggtgacaaaatctctcagcatttgcttgtctgtaaagtattttatttctccttcatttatgaagcttagtttggctggatacgaaattctgggttgaaaattctcttctttaagaatgttgaatattggcctccactctcttctggcttgcagagtttctgccgagagaccagctgttggtctgatgggcttccctttttgggtaacccgacctttctctctggctgcccttaacattttttccttcatttcaactttggtgaatctgacaattatgtgtcttggagttgctcttctcgaggagtaactttgtggcgttctctgtatttcctgaatttgaatgttggcctgccttgctagattggggaagttctcctagataataacctgcagagtgttttccaacttggttccattctccccgtcactttcaggtacaccaatcagacgtagatttggtcttttcacatagtaccatatttcttggaggctttgttcatttctttttattctttttttctctaaacttcccttctcacttcatttcgttcatttcatcttccatcactgataccctgtcttccagttgatcgcgtcggctcctgaggcttctgcattcttcatgtagttcttgagccttggctttcagctccatcagctcctttaagcacttctctgtattggttattctagttatacattcgtctaaatttttttcaaagttttcaacttctttgcctttggtttgaatttcctcctgtagctcggagttgtttgatcctctgaagacttcttctctcagctcgtcaaagtcattctccgtccagctttgttccgttgctggtgaggaactgcattcctttggaggaggagaggagctctgctttttagagtttcgagtttttctgctctgttttttccccatctttgtggttttatctacttttggtctttgatgatggtgatgtacagatgggtttttggtgtggatgtcctttctgtttgttagttttccttctaacagacaggaccctcagctgcaggtttgttggagtttgctagaggtccactccagaccctgtttgcctgggtatcagcagcagtgtctcagatggaaatgcagaaatcacctgtcttctgtttcactcacgctgggagctgtagaccggagctgttcctatacggccatcttggctcctccctgaattaatttaaaaactttttttttttggtctatatgcacattctacagttaggttgattttaattaaaaaacaagcatcaaatattagactattaaaaagatgatccctagaaataggaacatatgcataaaaatgttacacactacttacaatctttttaaaaagtaagcactttgaaaattagtgattttaataataaattaaatttttaatggcatttatagtttaccgacaactataagttttatgtccttgtttagaatttcatatcagacactctcacctgcttgttccagaattaccttaatttaaccatcagtaaatttaaaattatatctatgggcattctggaaccaatccccacctggtagaaatagagagacaagtataacaaagtttattatcagcatctatgatacttctactgttttcttgactttattatatcttgaatttatctaaaaatttatccaaggggttatagttcttcctttgtcacgctaatgctgagacgtattcctttgccttccaggcattttgctttctgagaatcaaaggaaagaaaaagaaaaaaagtatgagaaaatgaacaggcgaatctagataaatgaatgaagtggagggaaaagcaattcaaaatagtttattaaaggcatgaaagctcagacaagacattaagcactatcccaccagcctcttgtattcttctaactctgtgttttggagttcagtggctactgattctgtttgaagtaatgatgcctaaagctgtagaagttagattttggaagactctcacctttagcacatggaattgcataaattacattttactttattctctttctccacctcttgaacttcaggcttatttcttaatttcttttttaataatacctttgcaatttctattttcagagagagctatgtgcatacatattcaaggtcagtctagttaccctgatgttataaaacagctgatattttagattctagtagaaaataaaatcttctgaatttgattagcaattgattagcaccttactccggtttggatctttgaacatatacagaaagcctttgggaattatggtaactgaatttattaggaaagatcatggtaagaaagagtattcttgtaaaatctggcgtgttatgaggcatatatatatataatttaatcatggaatatattgttatctggatggaaactatttccgagaagttcatcataaaaaagattaacctggaatttatagagtgatgttttattaagaaaatgatcattcaattttatacaattctctgaagacaaatattgttttaagactctatattctacacaaaaattaatattttcatggtatgtttgtgctaccataacaatataccacatactaggtgatttacaattaatagaaatttatttttcacagttctgggggctgaaaagtccaagatcagggcaccagcattggtgctgagcagcaagagggcagaaagttttttaaaaatgcaatagcggctcaggccatcctcttaagacaacagttctagtactctgaacaaataatgcctttgtcattgctgttactaactccatcattgaaacagtattgctaggaagctggaaatgagatcacagagaaaataaaataaacaggatatatccccactgtgagtgttagaagatttatttaattcttctaaagcaagaatgagagcgtttctccaggagcattatatctttctactctgatgccactcccaaattttgggttgcattgagttgaggccagaggtaatggatggaaaaaaatggtaaactcatcactaactcagggatatttcaaattctcttctccctccatagtcagccttttagtatttaattttcagtgtcctcaaatcaccattccttgcattcttttcaggttttatagctgcattcatcaggtgagacttggtagagtgtgtttactccactttactcaacactaaagctttaccctgtctatttaatgttggagtgtccaggatatcaatgtttgatctacttctctctttaccctcattcctctagggaagccattcagtctcattgttttaaatagcactttttaaatatcaataacaccattttttttaccttcagttcagacctgccacattttatgtgcaactatctattcaaaaacttccattagatatctaataggcatcttcaatatatgtccagtactgaaatcttgatcttccttcccatagctatgtcttttgcagcctttagtacctcatttgataataacctcatcctttacatttctcaatccgaagaatatgaaatgaactttgcctcctctctttctttccaagctttctcaatttttcaggaaatcctcctggctctaacttgactatatatccaaaatctggccctttcatgttaccccttattgttatcacactggtcaggaatatcagctcttgcctaaattaaggcaataatctgtatccactgctagaattcaatctacaaaagggctataatcttagtctctttctatagtgatttgaaaccattggaaacagtacttggtacatataaaatattcaataaatatttgtgaataaatgactgcataactaacacttttttgttgttgttttctgttgtttgtgagacaggatcttgctctgctgtccatactggagtgtagtggtgtgatcatgactcattgcagccttggcttcctgggctcaggtgatcctctcacctcagccttgtgagtagctgggactacaggcacacactactgtgcccaggtaacttttgtaaagatgggtttcaccatgttgcccaggctggtatcaaactcctgggctcaagcaatccgcccgccttagccttgcaaactgcttgtgctacaggtgtgagccactgtccccagcctttaacatgtatgtataatagatatataaatttactccttactaaaactctgaggttgatactgtcatcattcttatagatgagcaacatggtaaacggtttcacaatttgtttgccgtattcatcctagctcattgcttattcaatcaaacaagattggttagctgatctcttataatcaatctcttcatactgactcaatacaaaccctaacattattggtagtctattcagggtctctcagagactcctgtgattcaagagtttaatttaacttctatctagcactgctgtgcccattggtatcatcacagtagagaataaatgcaattattgggggaaaatttacagaatttttacaggattattttacagtgctacatggacaatttcaagataagatatattggcccacagtaggagatgctctcctgttcataaaaattttcattaacataaaacattaatatagttgaaagttgtaatcaaattcatctaattagagatgtttccttaaagtaataaaacaaaatcaagatatacagaacactaaacaatatttttgatagatcccacctcttatcaagcaagcaaactatgaacatttaaaagtaaaacaggtaagacaacatatattcagaaagctagtagacaaatacgccctcacagctatcatcattggccaaaacaaagctttaccaaaaggcagacaattccaaatatttctgctgttatgaaccacagacctactcactttcttgggcagcttatttaccaatcctgagataaataaaaatttacatcagaccatgaatttaccctggcggcttgacattctggttggttgtcattcctcaagtaactgctgcaaagtacaccaaagcaaactaagatgccacagcaaggactctctcaattacaattttaattaaaaataatgagacaaaaatcacactaaaacgaaatggcctattaacctggtacatcggactggcatttgccaatcagttacaaaacaaccctatggcaggtcatttaaagacaccaatctcaggttcctcaaagttatacaaaataataactatgcagaaaagtgatgaaaattatataaatactttaaaactgaaaggaattataaaagtatcggacatgatgacaatgtagaaacacacatatgttattgcacaaagaagttgaaccattgtagtgaaatgaccaaaagagatcatgagcttgtttcaaataatagagtaggtttcacaaacctactctgtcactgggttctagtagggattctttagtggcatcttaaagtatgaagaatagataaggtcaaaaaaatgaacttccatttaaaattagcttatattcacaatggcagatcaaatgttaagtcatttatattttaattcactcattgctggaaatctttgttttaaagtttaaactatacgtttattctgaaaaatctcagattatgaggacattaagtacacaagggttttcaatccaagacataagacttttccaaagcttttgtgattctaggaattaaaacacaagatactgtgtggagaccagctcggttggggagaccctaacccagtggtgctagaggaattaaagacacacacacagaaatataaaggtttgaagtgggaaatcaggggtctcacagccttcagagctgagagccccaaacagagatttacccacatatttattaacagcaagccagtcattagcattgtttctatagatattaaattaacgaaaagtatcccttatgggaaacaaaggaatggactgagttaaaggaataggttgggctagttaactgcagcaggagcatgtccttaaggcacagatcgctcatgctattgtttgtggcttaagaacgcctttaagcggttttctgccctgggtggccaggtgttccatgtcctcattccggtaaatccacaaccttccagcatgggctttatggtcatcatgaacatgtcacagtgctgcagagattttgtttatggccagttttggggccactttatgtccagattttggagggcttgttcccaacaatactatttataaaaaaattaaaatatactctttggcatacaatcacttataaattaatcagccacaattggtagttatcagtggtgattataaacttacagaatattattgttgaaagtaccaaataacaaaaaaaactttccttcagtactgaatagttctattttttatgtaaaaaactctgtcattttaaacatgacattttaaaatcactgatttatcgctccactgcactccagcctgggcaacagagccagactctgtctcaaaaaataaactaaaaagtaaaataaaatcactgattttacaaagattgcaatagaaggccaattattgtgatttttaacataaaaaatagattcctttttcaggaaaaagatgggaaaatagtaaattgctaaaattatcaactgggcagatgtttgtgaaaattattaataaatgaaaaaagctatcatcctttaatatatttatttctattatgcctttaattttttatgcctcatgttttctatgaaatattcagctcacagtccctatggaaatcccagaagcaaagaaaatatagtatgaggtcatccactccagggacccgcccaactcatttgaatcatagttttaaaaaacttggcatttgagcttgagaaataaattagtatagtctcagataattgtcatgtttctgaatttatttattcataaataaaaaatgagaacattatctctaaagttctttttaatccccaaatctaataattttgctgacataattaactatttcagacatacagtaatataatggtctcaccatctctcagttacttaaaatggatttacttgcaaaactttttgaagtagaaactattttatcccaatttcagttttacacatatggaaactgacacaaacgtgatttaaaacgcatccaagattacaatggcaggactaggatatgaacccagagaaacgatctcaaaaatatgcattttccttctatctttgattttgtttaatctgacttttaaaattgacatattattatataaaatgtacataaaattaagtttatagactcatgtacaggttcatgagttttgacaactgtatgaactcatataaccactacaccaataaagatacagagtatcaggaagttttgttaacagtttatgaagaaagggatatcagtgctcagcccacaggtaactgaatcctgccaacgactgtgtaagtgcgctaccaagcagatccttccaatgttacagatctggagccagatgatctagataatctagactagctgtactcagattgctgaccaactgaggctgagattacaaagtagttttaagtcactatatgtttgggtaatttggcaggcagcaattgataacgaataccatgataacaggctcgtcataagatttgcaattgatctggaatacttggggcaaggcccaaagattcttttctctgggttgaatgctatccaaaagtgagggaaactctatgactggatgtcttaaaggtgtttacctgaaaggcagaaaggacaaagtggtgttaaaggtcaagtggcaaaaaatcagtggtcacttaagttagcaatgagagggacaaaatagattatggtttgggtgattttcttgtttcagtttctgcccatacataattctggagtggagttgctttggccttgttctattacggtcgtgtttctgatgtggtgtattttgaaattgtttatattctgctagagacaatctcacaccgccgaccagctagctccaagctgcaacagtcaggggttgctttcctctttgctggtactaaatatgctctggacagtcttgtacagtctttctttggacctgtgagttcgtttgtcttgagtaatatctaggagttaaattgttataatctaggatttatggagcattaccaaattgtatttatattagtaatgtatgagaattccagttgcaccacttcttgaacatatcctgctgtcacttttttaaagttttaggtattctaatgatgtcaagtagcatctatcgtggatttatgtttaatttatcttataattaatgattttaagtacttttcaggtgcctattagccatttgcacatcttattggttaagtttcttttcaactgtattggattttcttttccttattgatttaaataaattatacattctggatatatttcctttgccatttgtcaaatatatgtatcacaaatactttcttctagtctgtgtcttttgttttcatttatttacatttcgataagctgataaaatcaaaattttaattttgataaaatccaattcatcagtgactcattttagagtttgggcttttacaacatgtctaaagatttttgcctctactaaagtattccactaaggtatttccttctagaagcttaataattttagcattgataattagttctatgatccattttacattaatttttgtgcatgatgtgaggtagtagagtcaatgtttatccccctcactcttccctcaaccccctacagtggatatctggttgtttcttaactatttgctaaaaatattttccattgggttgctttggaacctttgtcaatagtccctcgactgtgcatgtctaagtctattatcatatcttttatcctgttgaattgccatatttgtctgtagttaatccaaaattacgttgcttccattactagagctttccaataagtcttaaaataaagtgctgtaaatgttccaactttactttttgtttcaagagtgtaatgacaattataagcccagtgcatttctatatatattttagaactagtttcaaattttctgctcaaaaatctgctggaaatttgaatgagttgtttttcaatctatagatcaattttgtgaaaattgacttattaaaaacattgacccatcttgttcttgaacatggtatatgacttcatttgtgtaggcctttttaactttctccctacaatgttctgaggttttactaaagaaataacacattttattaaatgtattcttaagtattttatattttgtgatgctaagatataattatttaaattttatttccaacgtctctagtaggtgtatagaaatgcagtagacattttaacattaacttatgacattgctaaacttgcttattagttatagtagggcattttcatatatttataaggattttctatgttagtatgtcatatataaataaaaccattttattcatttttgtgctgatccatgtgtgttgtatttctttttcttgccatattgcaataaatgagaacccctaagaggtatgatgttcaacagaattcatgggagaatactttcttaactcatttccagaatttgatctatcaaggaaaatattccacatgcaattaaaatgagtatagtgttgttcaatgtgtagttattatgttttataaatgtcagttaagtccacttaattgatagcattgtaaccttccattaggctcagtgatttattttctgctttttctattcactactcagaactgtgtgctgtaatatttgtctgtgtttgtgaatttttctatttttctctttagttttataaatatagtttcatctatctgaagacctgttattagatgcatacacatttacacattgaaagtgttcttttaaaaatgacttatcattagaaaatatttctctgtgtctctggtaatatttattggtttgaagtctaccgttctgatatcaatatagtagcatcagccttcttatgtgtgttttcattttgcatctcttgtaagcaggataaaactgagttttgctcttcattagtgtaacaacttctgtttttaaattggaattgagaattcctttcctactttttatctttttttttttttttttttttttgagacagggtcttgctctgtcacctaggctggagttcagcggcccaatctctgcttactgcaaccactacctcccgggttcaagccattctcccacctcagcttcctgagtagttgtaactacaggcgcataccaccatgtccagctaatttttatattttttgtagagatggggtttccactgtgttgcccaggctggcctccaaacttctgagctccagcaatccgctgcttcagcctcttaaagtgctgggactacaggcatgagccactgcacctggcaggcagagagtccctttattttaatgtaaatattgatcagcttggacttaaatctaccatcttattgaagcggctaccttgtctggggtaaatacctgaggtttgtcgtctcatttcaagaaaatttaagacatgggcacacacaaggagtttaggagtagaggcttaataggcaaagagagagaaagaaagaaaaaggaagacagctctctctttagtgagagaggggacttccgagaagaaaaggctccccccgcattggggggatgcgccagatttcatggtcaggcataaggaggtggtgtctgatttacacagagctcaaagattggttcgatcaggtatgacctttacatagtgccaggaaggctggcctccccacgccaatcttattatgcaaatgaactttccccttggccggctgccatcttgtctgttccttactgtacccgtggctgacaaagagaagggaagatggagcctcatgcaactgccagcatctatgtctgcagttcgattttacaggctgctctttgttagaaagaaaaataatttggggctgcttttcaataaaaggaaaaccttactgaggacttccttaccctaactatctgcctaagtaatttcttcttaactcctgtatcattatcatgtatctaacttccttttgtccgctagctcttcagactatgcctcttctttctatttgagcttagtatttttagtaatttcttgtaaatttaccttgtttttccaggtattctttgtatttacttactctgtcagttaaaatacatacactcaatgtattacagtctatcttgagttcacacaataccacctctatgtatattgtaagaaccttacaaaccttacaaaaatattatgtagtttacatttcatcttgttatatataacaacctactgttgatatacatatctgtgtacatacacacatatattcagtaaactatattgctattatttttgcactgaacaatttaatttcaaataatttaagaacaaaaaagtaaatctttttttttgttcacccacatatggacactttccagaagaatttaattacaagagaagatgaaatcttttatagcagatcaatgttcttgctgagaacagacatgataactgcgtgaatagcataatcatgtttaaagtgacattggagatctgtgaaagcagtgatgattaggagaattacaattctagagaaggcagaacattctaaatttgacctgaaaatctgtaagtgtgttttcactgaagaaatttgctaactctaaacacagttaaaaggctgaaggcatggcttggtctaagcagaggcccattgctgtataataaatacacgtgcaaattttggtttgttatgcaaaactggagagacaaaattggataattgaattcctcatgtacaaagctagatctcccctctttaaaaaaaaaaagtatttccataggtttttgggagcaggtggtatttgtttacatgagtaagttctttggtggtgatttgtgagattttgatgcacccatcacctgagcagtatgcactgaagccaatttgtagtcttttatccttcaccccactctcatcctttcccctgagtcttcaaagtccattgtatcattcttatgcttttgcatcctcatagcttaggtaccacttatgagtgagaatatatgacgtttggttactaaattccaatgctgagctctataggagactaaagaaacaagtgaaaattttttgaaaaaaagaggcttggtttcttaaagttgatgaactgaaaccatcacctgttcagttgaaatctttacaggccacattttagtgacatgaatcgaaaatatgcacagataagagccttcgagatacatgggacacagtggaaaagtttaatgtataaaattgaagttctagaaagagaaaagaggaaataggactaagaaaaattcaaaaagataactgaattttccaaacttaagccagtatatgaatttactaattcaggaatctttgcaaacactgatcagacttaaatataatttggccgggtgcagtggctgacacctgtaatctcagcactttgggaggccaaggcgggcggatcacgagatcaggagttcgagaccagcctggacaacatagtgaaaccccatctctactaaaaatacaaaaaaattagctgggagtggtggcgggcatctgtaatcccagatactcgggaggctgaggcaggagaatcaatcgcctgaacccgggaggcagaggttgcagtgagccgagacagtgccattgcaccccagcccaggtgacagtgtgagactacgtctcaaaaaaaaaaaaaaaaaaaagaaaaccacaacaacaaaaatatatatatatataatttaagaacatacagtgttatatcatagtcaatatgctgaaaataaatgagaaaaaaatcttgaaccaaaccagcaagaataaacacatttatttcaaacaagtgacaatgaagaccacaagaaaacaatgaaagccagaagaaaatggaataacatttttaaaatgacaatgtaaaatagagtaagtcaatgaaaatatcctgtaaaaaataaagatgtttacagtaaaacaataactgagagaacatttcctaagcaggtcaaaggaaaataaatactcaatgtagttctgtaggaagaagtgaattacatacttggtgatgcggacttatgaagaggaatgaagagcacgattaagactaaaaagtgggaaagcagtaaaggaagctaaagtgtccttaatttctaccatgattgtgaaaggactaagagtaattttcttattcgactgtgataatctaggatgcaaattatagttactaaaataacaatgaaaaactagtaaaaatatgtacttaagaagttaataccagaaaatttctttaaaaatgaattaatccaagggaaaatgacagggaagaagacaaaaaacaaagagctaatagaaaacagtcagtagattatagatatacacccaactatatcacatgaaattaaattgattacacattttttgtaaaagactaagattgtcagactggaaaaaatatgttgattactttagacactcatcaaaactcaaacagaaatttgatggtaggaatagagtataaatagtgctatactaactttaaccaaaagaaaagtggtatagctgccacaacaaaataatttacaatcttttcaagttcacttgaaacgtttaccaatattgattatatgttgggccaaaagaatgtctcaacatatttccaaagatgaaaatcatgcagagtattttcactgaccatggttaaattaagctaaaaattaataaaataagtaattataaatgtcccccactgcttagaaattaaatactgcatttttaaaccattattcaaataaaaaatcacaatgagtattaagcaacattttaaatggaaagatacaaagatacactacattaaaaccggtagggtgctgcagaaatagtgttcaaaggaaaattcatagaaaagaaaagaactgaatgttaaagatttgggtcaaagaaaccattcgaagaacagcaaattaaacgcaaagtggaagggaggaatgaataaaaataagagcataaataaatgaaatagaaagcaacgtgcaataaaggaaatcaacaaagtcaaatactggatctttaaaaacaactagcataaatgatagatcactggcaaaattaaacaagaaagtaaaagaaaagaccacaaataaccaaaccagaatgtaaaggattcatgtttgtagaacctacaagcaaaaaaaaaaaaaaaaaaccacaggagatattacaaaaacattacacaaaaatatttgctaatgtatataaactcctccaaaaacatacattactgaaatgacagaagaagggatagcaaaacatgaattttggcagtatggagatgtactgctttgatttcgcattaaggaaacccttgccatttggcagcaagtaatgtagtaagcaatctagctgatagcaacttaagtatccatttcaccttggagaatgagaccatactcttctcaggcagccccagtcaataagtgagcacaacaggggtagagcctagactcttcttccaaatgtggaactcttctaagaggcaatttttcattggagtagccattaggttggctgagactgtcatatttgcatcaagacctcaaggctctccctcatcaatcttgtttcttctccattttatgtttcataggcattaattcctgaatggattaactctcacattcctaagtctacatcagaaatatcttctgtagaacacaactaacacgtaaatacacagttaccttttaaagaaatcccatccattttttaaaacttttccagaagacaaccccaggaccagagagctttattaatgaattattttgaacttttaagtaaaaaataacacagtcctgtacaaactcttccagagagtagaagaggaggcaagggtgtgtttctcagcccattcataaggctatcatagcccaacaagaatgtcacaagaaaaaagagatggcaggccaatcaccactcatcaacatgatggaaaaattctaataaacttcttgtaaattaaatctagttatatataaggaaagattatatataatacataatcattatttatgtataatgaagttgggctcattcaagtaggcaaagtggtttaaccttcaaaaactcaataaatgaagttctgtttgtgaacaaagaagaaaaatgccacatggtcatctccgaagactctgaaaaagcatttgataaacattaacacacatttgtgaagaactctgtatgaatagaatggatttccttaatctgctaaaatatgtttaccaaaaactacacaaaaatatgtttattggtgaaattttgcatctttgtttctagaaacaaaaaaaggatggcttccaacctcaattcaacttagtgttgaactagagatcttagtaagtgcagtgaagcaaaaataaataagtaaataaataaaactaaggacacatggattataaagaaagaaataaaactcccagcattctcagatgatatgactatgtacatagaaaatctgagcaagtcaacagaatgtgagaatcaataagcatatttttgcaaatcacttgtccaaggacaatattcaaacatcaatcatgtttctataaaacataatgcaaaataaaattaaaaaatattgagaaaagcatttaatatatattaaatacctaggaaacatgtaatggaacatgttcaagattttttcagtgaagaatataaaatattgcaaatgaaaattaaagaagtcctaaattaagacaagactataccatattcaagatttaaaaactcactgtttcaaacatgtcaattgtttctaaaattatcaatatatttgacatacctccccttgaaatccagtggattttttctggtagaaagcaacaagctaattataaaatgttagtggacataaaaaagaccaagaatagtcctgaattcttgaaaagtagaaaaaaagatgcattcatattggcatatattaaaatttttatagagctataaaaaatgtggtttcagaaatgtttctggaacaattggttgtccttatttaaaaaaagaaatttcaaagatttccaatgtgttaatcatacattttcttaaaaaggataatgtgttgagattgattctaaggacatctgtctatcaaaacataccgttaggaaaagggaggaggcaatccacagaatgggagaagatatttgcaatgtatatattccataaaaaacttgtatccacagtgcttaaaaattgattttaaacaagcagaaaatctaatggaaaaaagtgagtgaaagactaaatagttacttcataaaaggatattcaaacacccagcaaacatgtgaagtgacctccatttcattagttataatggagatgaaaatcaaaattcctttgtgatagcatagcagtacacatccactagaatggtcaaaatgacagacagacaacactaaatattggtaaatatgtagaataactagactatcatgaaagtcttggtgcaaatgtaaattggtacaaccattttaaacaactagtgggcagtactgctaaaattcaacatatccataatatatgacccaacaatttaattctagatatacactcaatagaaatgaatatacatatatacatatatattcatattctatatattcttatatattcatttctattgagagatacacatatatgtttatcaaaagacaacaaaaatgttcaaagcagcactatttagaatagttaaaaactagaagcaactcaaatggaatgaattaaatccaaagcaaaccaaaacaaaaaaaacttgtaatataaacaacagtggacatctacacctcaatgagcaaaaaaatctactacgaatatttgcaacagtatgaatgagtctcataaaaataaagccagacacaaagtgtatgtacaattccatttatagagtctgtgatgtaaatttcaggatagtggctacctttaagttaataactgaatgggcaaaagaggggcttctgaggtcctgggaatgttttggttcttcatatattaagtttgtgaaaaatcatgaagcatatacttatgacccgtgtacttctttgtatatatgttaccctttaattaaaaagtttaaacgtatgcaaactagacccctaaaaattattacagaaacttctttcaattaagctagattttggatttttttccttcccaaaagttaccagtgtgctgagaattacattaaatacaattattttcatccaaactgcctctgtataagagctacaataccaaatacagaccacctcatttacacaagccaatttcatcaattaaagtataattatttaataagtagaaactaataaaaacgaacacatctttctgtgtttcatgagatttgtgatgttactttaatctgtagattgaacttatcctaagaaaatatatttattttatcttaaacatcacagctcaaattcagtttaataaaaccaatattgctttaccataccacaaactgctctgcattgttatttatacaattcttctattcccaacaaattaatctattctgcaaatatttactgaaaacctgctgtctgacactacaatgtgctgggaataaaaggcagaggataagatagtggtctcttcaggcttgcactttcctggatggaaacagacacaacacaatttccccaaaatcactaaattataatgacaattgctctaaagatggattacagcatcctgagcacagatgtaagagaataactgaactgtttctctgagaacaaacagttcaaactgctatctataagatccatagaaatgaattgaacaagaagaggagaggagtattctaagcagagactaagaatatcttaaagtcgagtggttaaaaaaagaaggatgaatgtgaagatcaaaagatcccagtgtctggagttctaacagtcagtagataatcagctggagcctcagtagggacaagatcctgcagagctttataaagtatgttattaaaatttattttcctcctaaaaacaaggaaaggcactgaatagttttaagcagaggagggacaggatcaattacatgttgttcatgttgtaatctctctggctgcaatgcagacaatggtttgtgaggcaagtcacacagctgcatgtagaccaaagaagaagctattatagaaattcaggaagggaaaattggtgtcttgaaattgattgattgtgtggagatggcatgtaatagatgattttgggagatatttagaaaataacgttgaatagatacgtttgtgttgtagagaaactgttgagtaaaacccttccagctggtactgtgggtatgtattgatgctgcttattaagatagggaatatggagaaaacagagatgagattccacatttagttgcctcagtaactgtgaagcttccagtgggatgttgagaagagagattgaggcccacactggctggttaactgacaaatcactgtcccccctttttttttttctgggaacacagctacctccatttcttggggttttctgaagttaggtgcagctatgcggctgaattgtagaatccgggcagaagcctggttcataactgctgcacagtccagtcccctctgtttctggttactgactgaggaagatgagtggaggcttgagtgtgacgggatagcagcctgccctcagtgactgcaaggggcagagctccctctaatgattcctagtgtgctgcaaagtaaatgagaaacagaaatgcacggtagaagcctaagccactgagacttcaggattgttttcacagctattagtttaccttacctaatggagaaattgatagtgaaagtgtggtgcttctgaaaaaaaagcaaaacaaaatacaaatgaactcacataatactcataaatgcatatgtgtgtgtgtgtgtgtgtgtgtgtgtgtgtgtgtgtgagagtgtgtgtgtatttgcatgttcttttgcttttttatagaagcaccacactttcagtcaaaaaataagaagtcacaatcttgagaggtcaaaaataagaaaactgttgtagactttttaaaaatggtggctttttgggtacatgattaaaatatttggtaaaattatcatcttttgtaacctactaaacctatagccctagggaaagaagttgaaaaaaatgttaatagtgtgttttggctcctgttggccaggtttgggtaggtattacaagaaataattgagattagtaaagatgagttagttttcaaagaactaaaaagagagtctagaaatgtggggtctcactaagttcaaaaagctgactgttgccatatagattccaaacagaaaaagtggaggaagggttgtgcctgataaaatcccttcgatattcagtctggtgataaagatccaactatagtttatcttccacacagttgtttcggatcttcttaaggtggctgctgttaggagtgaaagccgtggaagtgaggaagcattagaacaatatgttagaagaactttcgatattgttactaggacacagagtggaagcctattgaactcttgtatttgtattgccaaaaaaaaaaatgtgagctggattacatttaaacaaataatccaaaacaaaatgtaacaacagtacgatgaaaaccaaatagcgtctattggatgtgacaacataggtgccagtggtgaattattagtgatagttattttggtcaaatgagagataatggaaatcagaatttagctttgatttagcaatttaagattggtgaagtaaagaactacagagagagaacagacaagtcctttgataattttgactgtgaaagaaaagtggatatatgttgaaatgaggtaagggagagttttatttttgctcatgtttttgttacataagttcaggcaacttgagcagaatcaaaagctgaatggtatattcctatagagaagcagtttgaagttatagactattaaaaagtataaattactaacaaaggcaagagagcagctatgcaaatagagaagttctggtctcagacataaggaggaacacatccactgcaataacccagagaaggacgttgcaaaccatttagtcctgaagtatctaagcgcagtgaataccatattccctcctatgggaaacgtaagtgctctatattttaatctttcagacacaggcactccccaccattcccaaagaaatatgattgagacaatagagaagcatcacataatctcaatttggttatcaaatcatagtattaatactttggcagatgtattattttattaaaaataaatacccaccattgattagcattgctgctatttacagcaccatcaatttatatgcaataacaatatctcatttaatcctcatgcaatacaatacctcatttaatcctcctaaaaaactcacaagacaaacatatttctcacacacaccccaaaatctgaattttaaagaactgccccattgttttcccagtacactagtttgatttttttaataatggagattttaagttaaattgaatagatgaaatctcactttctggatgcctctcttatctattcacagaggctattctgatttccttattggtggtgatgaaacttttcagtgcctgaaattcaatatttagtgatgttcttttattatcaacccagaaatctgattcctctccactgcccttcttctgctgctcctgtaatccctgtgccaatagtgttgtgaaaagtcttctgaccagtttaagtttcaccaaactgtggtattgatttttttccggaaacctcatctctcaccttaaaatagcattcaacaaaacagtgttttggaaaacgtaagaaaatgtagaagaaaaatgtgttcttaatgttttagttctagccaagccaataccagacaaattctttgtgccataattacttctcctaggaccacagaaggaagaatgaatggaaataaattggagaaaaaaatgaaattggaaagaaggctgtcttattatacatatcacagacacttcaggtttcagtgcttcaaatttagaaaaagataaatatcacttgttctctctaaaacatgtagaacaaaaataatgagctcatgtctgtaagagtgccataaaatagaaaaaaatattagaactctttttataattggtctttaataaattatcactgcattttagaagcaaacttacttcaatgctgtggtcatgtaactcttttaattgataactagtttaataaacatttattgcttgctatgtgccatgtaatagggaataaatctaaatctccatggacttacattttagtgaaggaaactagacaataaagataaatttgtaaatgcagatagtaggtcaaatggtagaaagttctctatgaaaaatagttcactcctgtaatcccagcattttgggaggccgaggcgagcgaattgcctgaggtcaggagtttcagaccagcctggtcaacatggtaaaacctcgtctctactaaaaatacaaaaaaaatcagctgagtgcggtggcacacccctgtagtcccagctgctccgggaggtggaggttgcagtgagccgagaccaccccactgcactccagcctgggacagagcaagactctgcctagaaaaacagacgaaagaaagaaagagagagagagagagagaaagagagagagagaaagaaagaaagaaagaaagaaagaaagaaagaaagaaagaaagaaagaaagaagaaagaaagaaagaaagaaagaaagaaagaaagaaagaaagaaagaaagaaagaaagaaagaaaagagcagatataaggtataagccattctatagataggttgtacaggaaaactaactgagacatttcgagcaaacaagaaaaaggatgaggctcacaggtattttgaggaaaagcattccaggaagagtgaatggcaagtgcaaaggcccagaaagggcagagttgctgacgtacacaaacaacaatggctggggcaaatttagaaaggtgggaggaaatgggttagaagaagtatacggtattgagtggcaagataaaattgtgttttgtaagccatagtatagactttgcattaactcctgaatgtgacagggagttttaggaggttgcatacaaaactgtgatctgatttcccttactttctaagaggattattttggctgttgagttgagaaaagatggttgaaacaggaggtttaagaatggaagcagggggctgggagtggtggctcatgcctgtaatcccagcactttcggcggccgaggttggtggatcacaaggtcaagagatcgagaccatcctggccaacatggtgaaaccctgtctctactaaaaatacaaaaattagccagttgtggtggcatgtgcctgtagtcccagctacttgggaggctgaggcaggagaatcactttagcccaggaggcggaggttgcagtgagccgagatcatgccactgcactccagcctggtgacagagcaagattccatctcaaaaagaaaaaaaagaatggaagcaggaacaccagttagtacaggcccccagcaatcaggatagaagataattgtgtctcgaggagtggaaatcatgaaggacttattctgagaatatttttgaatattcaaatagctgataggggatgtgagaaacaaagacaatcaagaatgattcacatatctgggtctgcggaagttaaagtatggatttgttttttatggaggtggagaagactgtagaaggtgcagcttactgagacaacagcaggtctgcagtgtgatatgtgttaactctgagaggcctcaaaaacatgttgaatatccttaggataaatgagtctggattagttcagaggaagattctagactggagagatgaatttgaagtcattagcttattgatattttcaaccatgagattagacgttatttactaagaaagttaaggacaaggaattagaatgctaaaagattacatggctgagcaagaatgagcaaggagatttagaaaggcacagccagggagttgataggaaaaccatgagggggttttcaggagggcctcctgaaatccaagggaagaatgcatggcagaaaggagggaatgactgactatatcaaatattgctcacaaattgagtaaggatccaatgtcttgcaagaccatgcctaatgatctctcatttttggcctctttacctgatttaatgacttttctttcgttcatccacactggttcaactgtcatttcaggtaaaaaccttttctttactgtcccatttgcctggaatgtttctcccccatataacttacatgacttacttcctcaactctttcaagttttaacaaaaatgttaccttctcaggaaggcctcccctgaaaatttaccaccccagcccaaccctgcaacattcctggagtatctcacatgattaataattctccatagcatgtctcgcttcaaaaataccttatattctatttatgtatctaattagtatctatctccctgcatcagaatacaaactacactagatttttacctattacattcactgctagatcctagtgtctagaagataactgtagtagggtctcaaaatcacatgatacaaaatgaacgagaactaagcactggatttagcaatctggaaagcatttgttactctgccatgactaatttccatggagtattgagtacaggagctgattacatgggatttaagataaaatgataggagagtaactggagatgattatacatctcttttacataaatatgctgtagaggaaagcaataaataggcttgctgtagatcaatgtagaattaagtgaaggtgtttgttttaatttttattcttgtttgattattttaagattgggataaaccatttgaaagggaaaaatgctgattcagaagagattagagagaaaaaaattttggagtgataaccttccctcaaggaggtgaggagcctatgatctagaagacaccaaatgctttggcctaagaaaaatggggacttcatccacaataaaaagagaaaaagcagggattatgcatgttgatgcagagaggttgatagatgaataatggaaatttacagaaatgcacttctgattatttctaatttctccctaaaataggaagcaatttttgactctatggatagaaatagtgttggaagattgataagagttatgatatagtaaccaaccaggggatgtagaatagtgaatgttccagaccgtaagccagcaaattgtggctctcaggctaaatctaggccctcatgggttttttgtaaataaagttttattggaacacagaatatgtaagtaatgggcatttatttacatatttctattattgttcttgcactatgaaggtagagttaagtggttgcaacagaaacctcatggcacataaaacttcacagatttggccatgtgcagtagctcatacctataatcccagctagtgcaatggctcacacctgtaatcccaactacttgggaggctgaggcaggaggatcacttgagcccaggagtttgagaccagattgagcaacatagttagacctccatctctaaaagaaaagaaaaaactcacatttttgctgtttggtcatttacagaaaaaagattaccaaccctgttctagaaaaatggagtaggtttattgggggttctgagtgctcacctaaacttaggtgagtctcagcatgcgttttactccagccacattatgctatgcaggctcaagtgtggaggaataggcagacagctgaattaaatcaaggttggcatcttaccatgcttgtttaaggaaaatagagggtcaaaggagctgagtatttgacaaggaagattttacaatgatgaacttgcagtataagctagttactggggaaattaaggacataaggggactgaaggactgtaggagatcaatagataggtcctcatggagtaagaaagctggaaacagcagatggaagatggaaattagataactaaaaattagattatgcatggtttgcaattattagaaattgtgagtttttaggatttcagtggctagggtgggatggggtcaaaaccattggaggagaagaaacaaataccagcctttgcaactgacttgtcaaggtatttatattaataactgaagtctcctcttggcttaccagaaacctctcttgttacttcaagcattaattttacacttatataaatcaataggtattctattcagagaaatgtgaatggtacctgatgatgcttgggtattagttagtagatgttaagaaaccaagggaaaaagtcttaagctatttgtgtcaacttgtataaacaggataacttcgatgttaaaaatgtattttttttttttttttgagcctgttgcccaggctggagtgcagtggcaccatcttggctcactgcaacctccgcctcctgggttcaaacgattctcctgcctccggctcccaagtagctgggactacaggcgcccgccaccacacctggctaatttttgtatttttagtacagacgggatttcaccaagttggccaggatggtctcgatttcttgacctcgtgatccgcccacctcggcctcccaaagtgttgggattacaggcgtgagtcaccgtgcctggccaaaaatgtgatttttctaccatttgcatttatcacattgttagctctaacctactttgtgtactacttacaagttatgatctaggtggcttagaaaacataattacttttaagtcacggaggtgtcatttggtaaaattattgtcctgttaagtttcattcttgtgttaaagtaattggctgagttattcacacattccttgaagtgttgttagtatttcttaaaactcactccttgtttctgggaatcttctttatatatcaaaaggctagaatgacatcatcttttcttttgcaaaaggtgattaatagattagttaataggtgaacaggtttctataaaaaaaatagacgtcagagttaaataattttaaaagaccagaaaaaaatttgctaattctcaatgctcatttactagaaaacacaaaagaacttcatagtggatttttagtggatcatatgggtaagcctttaccggcatgtcaactaatacatcggccaaaatggtaatgttaatttatttatgacaagttgtataaatatttcagagaaaagacataccagtatctttgagacacaccaaaaaatgtggagagagagaaaaaacaataaatctggtgcttaaaatctggtgcttacacacacatagttagtatcctaagtgataccaaaaaagcacctctgctccatcttttggtgcaatattttttgattattgttctgtccgatatacatgaaatggtttggagaatttgactcacacagttagatttatcttcgaatattatatttctattcggatggctctcaagagacaaaaataattgttgaaaaaagtaaaaaagcaaacattgcaacacttctctaaagacaaaaatagttcccatgtttaaaatcagagcagtggtgttgggtagctggatgggatcagctcctctgtcagtgggttccaggttctcggagactaaagagtgttctctttagtgttccaacacctggacaacgaatacttgctcaagaacctagagtggagggcaaagaaccctgaagaaaacagtatatgcagtctcaattattttttgcatattttttacttaatatgctattatttcttggtctaatttggggtttttgtagttttgactttttaaaattattcctacatgaaatacattgcttccaataacattgctcttttctttctctctcttactcagagaataataacagaattagttggatttacacttaccggctcttctcctttctattttttaattttccaattgcttgtttatttttaaattttgtttggtatttccaactatgtataaaagattctacagattagcaatacagtggtcaaaatgatattatttcatttaatattttatttcattattcatttaataatgagttaaagaattgatttctctcatttttaagttgttttcaattttatattgctaacctgtgatgggtttttgtggtaaagagccaaataacctaaaatgatcagaaaggtaaaatgttttttgtaagaagaaactcaaggtcctgggcttatttaagaaaataaaaacacatttgagctagaagcattttatacagatttgactccattgacttaaaacaatcttttatctgaaaacctcacaggaaaccaaagagaatttcttcaagatattatagtataatttaaattgcatggtggtcattatatttctgctaccaggttgcctaaatgaaatatattttaaaatcacctgtttctattttgtctaaggcaaataaataaataaaacaaagatctacttgttctttgaagaaatctgatatttttgttttaacataaagaatgaaactatttacatgcaagttagagctgatctacacacatcttattctcaaagtaagtaatttccttaggcttaatattaaccttaaaattctcaaaaggaaattacttgctttaaggataaaatgcacatttttacaaagagaaattgacttttcagttttcaaaaattataataatcttataataatccactttttgtaaagcatatattataaaattgttgttcatattcatattgtgtagtatacaattatgttgcagctattataaggatttaataaacactggaagtaagaattatcatttaataagatataggtagaaaataattttattttcttaaaaataacttttaaaaacataattaaaatcctttgtctacatctacttataattattgtagacatttctaacataagttcatgaggttttcatgttcccattcaaagtaatatgtaagtagagactaatataattccttaagccttatgaaagttagtatttttattgataactatcttattatttttaacttgccataacttctagtttggccagaagaaatcagatctaaaacatacaaagcctagaaaaaatgtaaatacatttaaatttcattgctctcacctttgtattttgaagcaaaccaagaaagcatttttctttctgaattgcattaggcttttttttctgtttgtttgtgaagtactaaaggaaacacaaaacagtagagatcagacaagaaaatggcagcactcagaaaaagttatcattttctaaataaaataacctccaaagtctttactccctctgtccagcattctgatattgaatatttacgcacagaatcgtcattgaattttgacgtgttagttcagctcagctgaagtagaatcataaggggatggcatctattgtacttgaaaagaattcacacacataggaaagaggaataaacaaaacaaaaaagaaaaaaaacagatacactgcagaagctaataataagtacacaaagtacacaagtgtatttattacattttgcaagcactctgttctacatttcaaaaacgccaccatcaagctgttggcacatttatgtacaaaacagattaattgtaatgcctgctacaaagcactctgtgaaaatacaaactctaataccagaaataaaagccaaaagtgtcaacatcattacataagttgaaaagacagttttagaaattatcacaaactgttaagacacggaactgaaatactataatatagaatttaaagaagcccattaatacttttgctgaatatctgtaatactgcatatatcagaaaaatgttgaaccagtaagataatctaagcataaagaaaaggaagcaaaatgaaccccaaattaattaaataatactacggaatgcataatcatgccacagatatccctagtagtaccccctacctactacaagaacttgtaaaattactgatgatgcatgactagtcattgtacaaagattgtttcactcaataaatttttattagaaatgcagttacactgagaaaggatttcacaatggtcaaatcagtgcacaatactacctagttttatacactgaaaaaaatgtcttgtcaggctacatcattttagaagacactttacagcattcttgtagcattagaaataatgaaaagaagagcgtcaaggtgaaaacaaacaccaaatttggtccaataatactgattgctctttgttaaaattcctttgatacaggtactttttataaatgaatatgaatgaacattcggttaaaatgacttacttgaaataaaaacacaaatatatcactacactttcaaacaatacattctataggggcctctgaccacactttataaaacactacaggtaaaccaacatagattggaaggctgcaagcaaagctattatattaatggaagccttttcaaatatatcatacacattttaggaatagtttacagaggtgcaatccattaaaacttttaaagtaggtaaaacaacttccgaggggttagtgtgcttatttgtaataaaccaccttcataaaggtaattaattttccacattagcatattaaaagttccaatccagccacttcttaaatcacaaagagatcattcttcaatagtctacagtagttatttccattaaaattgtctctatatactaaactttaaaaggtaagcctggtgtcacaatcttaaaaaggcaactagccatgcattagcattactgtttctacatgctcacaacataaacatgagtaatctgagggaaataccttttaagaacatcaaggaaaagtacaatgttaacaaagataagaagcacttttttttttaaacctactcttacaaatttagaaattgcaccttagattgatgaaaacatgaaccagggcctacagtaatatggccactgatcttcagacaaaatttccatatttcaagagtcatcaagatgtaatctctatctattgttcataatgtacaatggtccctttgaaggttacctgtagttaaactagttaccgaaatcaaaactaaaaagtataaaaagctattttcttttcaaaacataagaaataatgcaaaaggtgttatgtataacacatgggaagtggttaaaaatcaaacaaatctttgcatttgacaatgttagtatctttgattttacagaactagtaaatgagtttgagaaatttcaaaaaaaaggctggataggagcttgtagaaaagatctgatttacatcaatttaataaattgggaaatttaagtgctaaacaacaaagaattgtactcaggtgattcataagtcaccttacatatcattgatgagaagcactttcgttttgttttttaaaggttggatggttggatggcccttagttaaacaccaatgcattcaaatggtagaaagaacaggaagatgcatttatgtgtatgcattgagccgctctttggagcgagtagagtggatgtcatgaagctcttgctcttccttcgacttgatgtcttcatacttctgcatccggcaggcgtctttcacataggcccagttggcagacagaaccataaggtagtgaacctaatcaaagagaaaaataatttatattggaagtttgttcagtgtcttcattacaccttgctatctcgaaagaagtcttcgaattatagctctttataggaaatgttcacatataaaatggaaacaaaatttctttggtaacagaaacaatataaaatatattttcattcctccaactatatcccaccatattcttggcaccatttctttcagtatctctttctccttttcaattcttggaagtaatccaaaactaattcttagtctttataggatgtttcctgcccaatgtgtcctcatttgcccaaaccatagatgattcatttcatgttcatgtatctatgttttataatccataatcagaaatattttcacataccgttgtgtctaactgacttgaattaattggaggttctattaccccaattaaagagagatcatggaaacccccaaatatacctgtggacttgattatcaggttaattttgcatatgatgaattttgtagtttctttttggttataaactacaggagataaaatattgtgttacatggattttttatatgtatatacattcacaaaaactggaatagtgccatgttcaaaaaggaagctcctggtttgtcttgagtaatgaagttgctggagaaataaagctcctttatttgacttgagtttacccagcaatgagaccgcttatttgtttttcttttctttcttccctcttggtccacaggggagataaagcagctttccacatgatgaattttgatgaatagggaagagaaactaagttgacagttatttacattctctgagttttaaagggtgggcaatattttaatccaacattcagaaaaatagaacactaagattttgataattagtaaacagtacattgaaagaggaggcgggctggttctagaaaagtacagatggatataaagaatgcaatgtcaattctaaataatgaatattgtggtgtgttcaggtagtcaacaaacagcaaaaaacaaaataattttgacacgggatgtaggggaaaagatgcataccactataaataacctatttttagaattttctgtttcctctgaagtttagcattttgtttaaggaatattgtaagccacctgaaagcaggggctgtgagttatattcttgtacattatggcatttacatagtgaaagcataatcactgtatatatatatatatatatatatatatatatatatatacatatatatatggattaaataaggcttatacacataatgaagtttatgcagtattttgttgctgtaaaatatcaagtgctgtggagagtgcttagtacatagcagatacacaaaatatttgccaaataaatgaatgtatttttcaatcttcaaaaacttttcataatatctgagaaaatgtggcccccaaattattattaaatatgtataattgaggccaggtgcggtggctcacgcctgtaatcccagcactttgggaggccaaggcgggttgatcacttgaggtcaggagtccaagaccagtctggccaacatagtgaaaccccatctctactaaaagtacaaaacgtagctgggtgtggtgccacgtgcctgtaatcccagctactcgggaggatgaggcaggagaatggattgaacctgggaggcagaggtttcagtgagctgagatcatgatactctcctctagcctgggcaacagagtagactctgtctcaaaaaaatacatatatatatttacataatatatattatatataaaatatatatttttatattatatatattttacatacatgaggaagcacctgtttctgaattggagtgatcttgaatttcttttcagtatttcactcatgcatatatatatatatatatgtatttatatatatttatatatgtaaatatatataagataaaaaatatatttatataaaaatatatataatacaaaaatatataatatatttatatataaaatatttgtaatataaaaatatataacatataatatatcatatataatatattatatgtgatatataatatataatatattatatatgatatattatatgtcacatataatatatcatatatgtgacatatatcatatattatatgtgacataatatatcatatataatataaaatatatattatatattatatataatataaaatatatattatatattatatattatataaaatatatattatatattatatataatataaaatatatattatatattatatattatataaaaatatataatatataacatataatatattatataatatataataatataatatagtatatatataaaaatgtataattatatatataaaaatatatggagagccttagaaggactcccagtaacctcatatatatatgacctttatatatatataaaacctttatatttttatatatataaaaatatacaatatattatatattatataaaaatatattatatattatataaaatatattatatattatgtaaaatatataatatataatatatattatatatatattatatattatataaaatataaaatatataatatatataatatatatataatatataatatattatatattatatatatttatatataatatattatatattatataaaaatataatatataatataaaaatatataatctatatataatatataatataaaaatatataatctatttatatattatatataaaaatatataatatataatataaaatatataatctatttatatataatatttatatattatatatatatatatacatatatgcatgaatgaaatactgaaactcaaggtcactccaattcagaaacaggtgcttcctcatggttcttacaagcatttcctctggccttaaggggaacccaagctgcagggcttattactgtccctcgctaggtgaacagtgattactgaaatctggtccaatgctaagtcgatttactttgtcagcatgtaggacttcctaacttctctacaaataatggagtagagtagaacagaataagttcttaagaaatattattaataacattacaattactattctcaatttttaatattaagtttttaagaaatattattaataataaagtccctgctttattattcctggtactagcagcattagtaccaggaacagtagcagtagttatattttacctgtctcccaagacctacatcattatcagagctaataaattggaaatacttaggtcaatcatttaagctagtatggggttttgtgatgactctagacagagaaaataacccccaaataatgcttagtacttgaaaaaataatcttctaagctttctgttttaaataaaatgtacgtatagctttaagtatatgcaaagcatagattgcttaagaaatacataatatataaatttctatcatctcaaaatctgttgatttgttttgagagtaagcattttcagggacatttaaataacatttgtctaaataggtgtttttcactagtgtatacctgtatttttagacagaattttatatgcacatatatgtagcaaatgcaaacaaatatttattatagtccactttttaaaagataccttcacagacttcttgtacctgggtatatattgcttgtacatacccgtgtcattaaagtttttgacagcatagaaatgggtgtatgaacacaagggtacatatgtttcctctgatatcacaaccagcatgttttctcctaaggacaataatgtttggtatatcattggccagaacttgctgattcttccccagggcatagtttagcattaattttaggttgagaatataaggcctttgcttttgttctattttgatccccccaattaatcaaccaacatgatccttatcaagcgtctcacgttctgaaacaaaatttctatatagaggtttattctatatagaggtcactgtatcaaaaatgttgagcaacgctaaagtaacaaaacatcaaaaattcatgttagtactgacatagttttattgaatatatatgtaagtcatttttaataaaacaaattaaatacaaaatatttatgaaatcagtaaaataaccactctgacatggctaattagcacattagtattttctcatcattcttatttttagtctctgacaagagaaaaacatttttttatgaaagtgttcctttcaccaatacattagatagatattggcaccatgaggaaaataattaaataaattccaattcattcaccatctttacatattgactcggctgtcacagtcgtgaggttactgggagtccttctagggctctagactactcatcctcaaggatacaaacaaagactgaagatattggctgcaaaagctattactgacactcagagcacttgctcagggttgatatttggcattccagtgggcatactggaactcatgccaagttagaaaggaggagactggctctggcacgtggtagatcctcctcattgtgtaaaagcttgatgtcttaaaagaagatctaaagactggctcttaatatttctgaagcaaattagatatagaagacatgacttgaaactactgacatttgttttttttaataacctaatttgtttttcataaatgactctatatggctttttaatgttcttagctaaggaaaaaaaagtaaatcaaggaattgattagattactcacaatgtcacattggtatgtacatatatgctacagaaataatttttatatttatagtaatctaatatctaaaatcctaatgaattactatttttgttaatgttctcaatatggtaataataatatttcttggggtttagtcttgttgttgacttacttacccattgttttccctactttttttaatctgatgacataaatgtgttttacatgaacttcaaactttagagatagtttatcatctctacaagcaaatagctttggaattcacattgaaaaccaagcaccagcgctttgaggtcttaccatagcaatgactgctgccccagctccagcaagtgccacaataaacaagtggaaggtcatgttcagctgcaatggaaaccacagagaatcaaaaggtgtcagagttataggtagaagagaagtcaagattgctactgtcttataaacaagactttgtacatcttaaataaaagcgagcctgtgataaatcacccacctgattaaaacagattattacaatatattttcccctgcaaatcatttaaatcctttcaacttcatcattataacataatttcattataaagatgagacaatgattaataatgatggttttcatcagtaacattataacaatataaggagggctatgctctctttaaaaacaacttcatcatgttttcagccttcattaaaatgagtttccagaaaatttgaaatagttattataatttttattgaaatatgcagagcatctaattcctatttatcctctactcctcctgaataacactacttcaggtaaaattgcctctgatagaataaagggaaaagtcaatatagatttagttttaatacattatccaaataataaaaaatgaatgctaaaattctgacaaaattaaaggctgtaaaaacactcacctcagtagattcgcacatcctcaagaaattctcagagacagtacaaattttcttttcctctccaattgtcacaattcctacaatgtgtgggaaatgacagtttagcagtataaatgttttgaagagccaagagagaaaaaaatgagtttttgctaatcaaatctaagcaagttccattttatcttatgttatgttacagtggaaaaataatctagctttcattgtggataataactatgcatagaattatgaatataatatgcaagactatttagccctcaagcaatttaaataatttcaatctgaattcaattgaatctcaccaccagaatttccagactcaattatagccagtttattggtttggcccattaatgtgatagtataggcatcacaattattttgttaactatgccccagactgtgctgaagtcaggatctaaatttgttcagctggtgcagtgcttctgttaatctctaaaagcatactgcccaaaggagtacttttttttctgccaatattgcaaacaatgctattagtaacaggaaatgaaaagttgccatttcgcttctatttacccttgttccagttggttcatagaccaacagcattagaatcacctaggaagttgtcaaaaatatgtatttttagactctaacacaaaactgatagatgggaatctatgaatattaggcctagaacactgcatttttaaaacgagcacagaggcaattcactggcacgcctctttgtctcatcttagagagcaaaagtaaccaagttcatctgagcatggctctttaattttattttctgaactcttgaagtgctaaacacatacaggcatgataaaacattttcaggacattctaatacctaagattttagcattttctgctctttagttgtttttgttattgttgttttattttcatggtttgttttgttttgtttgagacggagtctcactctgtcacccaggctggagtatagtggtgcaatctcagctaattgcaacctacgcctcccgggttcaagtaattctcatgcctcaacctccagagtagctgggattacaggtgcccgccaccacacccagctaatttttctgtttttagtagagacgagtttcaccatgttcaccaaactggtatcagacttctgaccccaagtcatctgcccgcctcagcctcccaaagtgccagaattacaggtaggagccacggtaccaggccttctttatttagttttaatatgtatatgtatttacatattcttagctttatggggtgtcatcaactctccctctcttacagagctgctgctattagtttgtcctttgccaatagtttgtggaatctatttcagtgtgaaaaatctatttgcagtaaacaaacacagagatccctctctacagcctttcctttctgccaagatggttctaagagtgggtaaaaatttaaaagggttctctcatgagatttcctccctaaaaaatcaccattgttgaaaaagcttctggtcaaggctctctctcttcatagtaatccattacagactttattttgtggaatatttatgttgtgcttacatttccttattcatttctcaattcatgttttcagcaaaacacctagaaagtgttgcctaacctcactgtaattcctttcctttcatttctacttaaatcctctcaagtcagattttgccctaacccccctccatggaaattttcttataaagataataatgacctccaaggattaattctcagttttcatcttcttgcaagttgacagtattaaacacagttgatgcccaccttttccttcatgctctcttcatttgtcttctaaaatctacagttttcagtttttgcctttctgatctcattggctccttcttctcatatttttgtctgttgcctcctcttctctctgacctcttaagttgcagcttcccacccttcactcctcagccttttttctcccatgcatatctcatccagtcccagatatttaaatactgtcaacaactcctaaatctatgtggccatcccatatctctcttctgaaatcaggattcatatatccaatttctcatctgaccattctatttggatttctaataagcattttaaaaaaacttctgctcttctcctttgctggctccactcccaagcaaacacttctcatagcctttcctatctttcttgatagcaaatcttaccatttgctcagtcaaaagaaattcctccttgaattctcttttttcccccgcaaaccctacatgcaatctatcaggaaattctgctgcctctatgttcaaaatacatccataatcagaccgattcttcccacctcccttgccatctcctcatccaagccaccaaaatctcccacttggattaatacaatcatttgctaactggcttccttgcttctacccttcctacaaaccattcttcaagtagcagctagagtaatccttctattattagtcagaccatctcctgcctctgccaaaatctgtaatgactctctactcccctcagaataaaaccccacacctataatgttctgtaatgcattcatcaagatggtacatcgtgggaactcatagacttcatctcagtcttttgtcctactgtcttgttctacttcagacacattgacttccctgttgtttcctgagaaaccaggtatcacattggcttggtaacttagcaccggctcttctctctgacaagaatattcccagagctgagctactcctgtccttcaaatgacaactgctcagtgcaatttttctacatcattaaaaaaaaatactatcgttacagtaggtagtcagacatgagcagagcaagagagaccccaactcaccgcccaccaaggatgtcaggccaccatcaggtgacagtcaggtagttgttaactgtctttctaaaataataattagtcacagctggctcctaataaagaaacacctgtagctggtgatcggcagcttcttgatctgaactcaggagttgcagaagcgggctcaagcctgcacactaagaggcaaaatggcagagtgtaactgatatatgaccttcctctaggaacactcaaatgagcatgtgtgcaactccagaaaacacagtgcacatacggtccttcccaagtgccggccacccactgcacatgcggacagcccacctcaagggaagaaccaggtgagaagtatgcaagaccctagaagaaggccaatgtataaaaccccaagtcaaaagatccaacagggtacttgatctctcaagtctcccgcttggcccttttccaactctactttctttcattcctgctctaaaacttttccgtttgttttttttttttttttttttgagatggagtctcgctcttttgcccaggccagactgcagtggcgctatctcggctcactgcaagctccgcttcccgggttcacgccattctcctgcctcagcctgctctaaaactttttaatagactttcactcctgctctgaaacttgccccggtatcttactctgccttatgcccctcagttgaattcttccttctgaggaggcaagaagtgaggttgctgcaggcccatatggatgtaccactgctaacatcattactgaacctccagtactcctgatgctatatgtatatgtgtatatatacacacacacgcacacataaaataaagtttttgtgataagtataccatatataacaaatagatataatatatattaaaaattaactgtagtttaaaaatcaacatgtgaataatatgaagctctagaagggagcacgtggaggatgagctgcagtgtaaatttgaaaacctgattattttgattctcatatatctgtctatgaatggccaaattgttctcaccaaaaattaagaacattattcaaatttatatcaatttttctaaatattgaatatatatatttattacctatggaaaagtttttagctgaaaggtgcagactgatattttcagtttcttcaaagcaattaggagaaaaggcaagttataagcaagggaggccaggcgcagtggctcacgcctgtaatcccagcactttaggaggatgaggcaggcggatcagctgaggtcaggagttcaagaccagcctggccaacatggtgaaaccccgtctctactaaaaaaatacaaaaattagccaggcgtggtggtggtcaccagctacttgggaggctaaggcaggagaatcgcttgaacccgggaggtggatgttgcagtgagacgagatcacgccactgcactccagcctgggcgacagagtgagattgtctcaaaaataataaaaataataagctgaaactaggcaagagaagcattaagaactgggtgcaaagagaattggggagaacagggaggacttgatgcatgaaagttgcagtaacgggcttctttagtaccttatatttttcatgctagctaaacacaagtaatatatttctggaattgtgagaattatttgtacttgaaatatgaacaacgtcagagaaaatgatgcgtaatgtgtgtacacggttcctatgactttcatcactaaggcaataaaaacctttggtgcttactggacagttgaagtgcgactcctagggttgtaaattcctcttaagaaaattgtaggccgggtggggtggctcacgcctgtaatcccagcacttcgggaggccaaggcaggtggatcatttgaggtcaggagttcgagaccagcctggccaacatggtaaaaccccgtctctactaaaaaaacaaaaattagccaggcatggtggcacacgcctgtaatcccagctcctcgggaggctgaggcaggagaattgcttgaacctgggaggcagaggtttcagtgaaccgagatggcgccactgcactccagcctgggcgacagagcaagactccgtctcaaaaaacaaacaaacaaacaaaaattgtaaatgagagttggagttaagcagaatgagcagatacttatgacactctgaggtctgatagcacgataggaattaactccctactatgaaatataaatgcttaaatttaaaaataatttatcatttacgttgctaattttaaagatgataaaataccagcatgtccttttgcagattctagagaccacccacttcccctggctctaggggggttttctttattttcaaagtcagcaacaatggatcttttcatacccttcctctatagtccatctgcctctgaatgactcctctcctttggccctacttttcatttttaaggatgcttctgattacattgatgccacctggataattcaggctcgttactttcttaaaatcagttgattagcaaccttaattccatctgtgacttcaattcccccttgacatgtcacctaacatgggaataccaaacagaggcttagcctacacaggaaaaatataaccaatattttaccaaatgaattattgaattatttagcagaaatgaatatagttcagtaattagcaatgacacatagctagatatacaaaagaattcctattaggagtatatgtatctaatttttatgcaaacataaagtgtccttttgaatagcacacacttaggttaaaagcgctatttatttctagtttcaactctatcttctgttacatcttggacaaataatggaatattcctaggtcttggctgtcttctctagagaaagtatgatgagccaggttcatgatgtaagtgtcaaacttcattttatatttttgtcatgaagatatttttctttcaaaattgagcagtactagcacatgacacaatttttccttaaatatttgttgaaaatgaaaccaacccaattgtcccatggaaatgatatttgtgggtttttgaacaaacatagaaattaaccctgctggtcttaaaacttgaaatttacatttgtctcatctgagttcctccctcaggaaactcaccatcaggcaagggactgaagctgaccagatcaccacatctagacaatgagatgccagactctcattcatggttacctccttatcccctaattcctgttttacattccttattcactatatgaccccaccaccaattttagtggtagggagacagatttgagactgatctcccatccacctcggctgcagtgcctgaaaaagccttccttcctggcaatactttctgtctcagtgactggctttctgtgtggcgagcactgtgacctagatcgaatccctgctttcagcaacaaaaatagtgtgagcaaataaatgaaatgaaatcctactgagaagtgctttatggaaataagataaaaacaagctgctctcgctaacatgcgtgggtgtgctgaataagaggtaggattggctaaaagtctaaaagaagccccacctactttctctctgtgttggctcttaagttttatcaagtcttcaggttgtaatggaggaaagttttaaaccttacatctagatgatgtaatgaggatcagtttcaacatttcctcacataaagttatggggataaacatctaatacatccaatgtaattgaatcacagaatatataattggaggataacagaaatcataataaaagcatcaaaaatacgaataaaattatttcatgagcagtttgaaatacagcaaatcctaatatgatatgctatctataaatcctccaactatatcaagtaatgtctctgtgtgccattagaactgttcgaaatgcataaatttattacatgcatgggaatgaacagtaagatgtatacctccactaagtaggtataatggccattataggctgagagttcctattacatattaaatacctagtctcctgtaaaataaaagatagcgtctatatactaaggagacaactctgcaacaagggaaattaaagtatattcttatctatgcaattgtctttttgatgaatattagtaaattctgaattgatcctaatacaatgtttgaggaatggttctcttctgatgcttcttgataataatgtggttatatacatacattcaggagtcttatcaggacatataatctggagggcaaataaatgctatacagcaatagattttatattaagagctaaacagaacgtcttaatagctcatgtaaaggctgcatgacatctaaaaagtgccttctctttctttcaaatccataaaagaaaaggtacctttggataaatattgataaatatgttgtaaacattggtaagcttcaaagaataattttaaccacatatttatgctttacatagtatagaaagaaataatatagcacattcttttctttttttaaaaaaaaaagacaatcagaggtatgaactaatgagattgaaataaggtttttgactttgagttgatgccataatgggatgaaacctttggaacttggggtaggttgaatgtatttcacacaaagaaatggatgtgtatctttggtggccagagagtagactgcagtaggcaaaaaatagcctcccatagatgttcacatccttaactccggaacttgtacctgtgttggagtaagccgtgaaggggaattaagcttgcagaattgtcagggagaggcaactttgctggctttgacagaaaatggactgccatcatgatcaagtaaatgtaggagatcacaaaaacagtaagcagtttgggaaaaaaattgaccttggctttcgatactgtatctgtctcctattgctgctgtaacagattgtcataaatgtagtggcttaaagcaacacaagtttgtctcttacagttctggaagacaaagctaaaaccaaaaggtcatcagggctgcacttctctggaggccctagaagcaggagcagcttcctttcctattccagtttctccaggccacccacatgccttggctcttggccccttttctccatctttaaagccagcaacactgcatctttctgccttttttctatagtctgtctatctctgactgactcttctcttctgactctctcttccactttgaaggatccttgtgattacactgggcccatctggctaatccaggataatctccccattttaagatcagttgactagcaaccctaattccccattgaaagtaatctcacatatgtatatgtttcaggaatcagaatgtgtacatctttgaggatcctttattctgtctacttaatagactaatggtttactcaagattatagttgaaaaaagctcttttgctaaaaattgtattggaaaagctgtcgagtagaaaataattgtgctaagattcaggacactcccctttcaatcccagcacggcctgctgggtagctatatccctggaaaattatttcatttcttagggctccatttcttttagaccagacagctggactggtgacaaatgaagtccatttataaaattctatggctctaagacatattctgtgcttaatgtcataaggaatcctatatacttagtggtataagccttaatactttcagtgaaattaggttaatttggggatcacaagcacttgaatgcattgagaattaataagtttttctctttttaaagttgaaaatattaagaaggtctatttatcttttacaaaggattattctttctgtcctttagaaaacaaacttggggaaattttaaatattatttttctagagtctcccaatgttttttcagtttagaatctggtttgataataccaaagaccttataatcacctacttaactatttgcatttattatcctacaggaaatgaaatgttcctaatcagagcatgctaatctctcgtgtatttctgaaagtataaaccatcacatacaagagaatccgaccctcatgttttcctgtggtaacactttcttaagattaaaccgaagctctgagagtagggttaacagatttaacagtgaaagcaatctcagtgtcccttagttaaacctgaatttcagataaagaacaaatcattttagtataactatatcccatacaatatttggtaccatacttgtaataaaaaatatagtttgttcatctgacactcaaatttaactgggtgccctgtattttaacctggcaaccctatttgagaggctaatcacatattttccaaatttaacttttaggatcagcagaataaaaggaagacatttaggacaaggggcagagagcagagccacggccttctaagcagctgttctgcagtgacctccagtagcatttgctgtgggctccttttccgatatttacaggggatttgattttgagagtaaaacctccccaatgtccatattccctcttgccaagaacgtcacccatagagcatattattctgcttttccccccgtacacatgtacatatgagtactattattatgtgagatttttgccctaaataaaataaaacaaagaggactgctcacttatttggcactctttgatttcattattttatttatttatttatttatttatttatttatttatttatttatttattttgagatggagtctcactctgttgcccagtctggaatgcagtggcaccatctcagctcactacaacctctgcctcctgggttcaagaaattctcctgcctcagcctcccacgtagctgggactacaggcatgtgccaccatgcctggctaattttttaatttttagtacagacaggatttcactatgttggccacgctggtctcgaactcctgaccttaggtgatgtgcctgccttagtctcccaaagtgctgggattacaggtatgagtcaccacgccccacctgatttcattattattaaatgcgaactagtgtactgtagtggatcacactacacggggactgaaggcttcatcttgtaggatggtgggtgagccactgttctgaacacacagctagttggctaccctataatctacttacagtataactgtaaagccacaagcccttcataccccatctaagtgaaatgtctcctacttttctgaagtatgaggaaacctcattagagaaaaacgctcagtgtccccaggtgttagtagggtggcttttaatgtctgttcagagaaaaaataatccatttgcaaatatggatttgcatgtcttttataaattctgtagctcccataatgttacacatgataacatagaatctcaaataggctgagattatactctacctttccacttccagctcagtactaagttttaatatgaaaggcagttgacttatgagcaagaacacagcctctgattcaacctgcgttgcccgtgtttgaatcctatctctgtcagttgctagctgtataaacttggataagtcactgaacaaccccactgtgcctcagttttgtcatctacaaaagaagaaaacagtatggcctactatatagagtcatgagaagtaaacaatgtgacacatgtgaaatacttaaaatagggtctatatgtggtaaatccatatacatatgagtattattactacatgagattttagccctaaatgaaaataaccaaagcagactcctaatttatttagcgtttttttttttgtttttattattattaaatgctaattaagatgctgccctcccatttcagaagacaatgaactgtgcccttcttaggtgatctttattgtagacttgacattttgtgcagtttatcatgggaggataaaagtagaatgcagacatcacgttgagtttggaaaagagcaaaggaatcaagaaaaggaaaccacacttctaacctgtcaatatcaggtaatgtgatctgacatcctggtcaatatacatgtgtatatgttgtgatattaacatccattcacccttgactttctactttaaatttaaagggaatagccttagcagtaatactctgataaatttatctctgtggtagaaaaggtactgataattccaaagtgatctataatattttagaggcagctatgtaggtaacacaatatgggatggtgttttacagtttagagatccaatatccacttaccaaactgacgaaggtccaagcagagatttgctccctccactaatgtggtgttccggcagatggtccacagattgaagtacatgtaaactggcagtgaggtgaaagccgtgactcccagccaggccaacatgaaaagatatgtcagcataatgaactgcaaaagagaaagaaatggagagagaaaatgtaatctaccaaaaaagaagaattttgtgtttaatctgcaaagctccattataggaagtttatgggatacagtacataagtcagtatcacaacactgttgatttgcagcacagaaggttgagaaatagtgcgcataatgggttaagtgaataaacctgctggaaaatcatatcttggcagaagttctgatgtacaaagaaaaaaataatccatctgcattatcatgcctcttcatccatgtatttaactttcaaatctcaccacagattttttttaaactttagaaaatattcctgggtatttagaaagtattcactttgcaaaaggaattcaggagaattaaaagtctgtcaataaatttccataggactaaactgtcatcatgtcatgtcgcaaatatttaagctatttaatcatgtttaccattaacaaatatggcaattctcaaatcacattagtatataatattagtgtgtactcttctaacatttttataaacttaagtctgttttgttttatgcatgttaatatacatattttatatatagtatatacacttatatatggtaaaatattattttaattttgaaaatacccaagctttaaaaatacatttcagaaacaatttttaatatttataaagtgtatacaaggtgttcatgtatcctagatagaattgaataaaatacttagtttaagcatggatttacatgaagctttagttcacacatggtaaatgctggataaaaggacatgtagatgtatgaattagtggatggatgatagacattagacagaaaactgtctgaaatatagcccctggatgccaaaatctacatttctatagatatttggttcttctgaatttcagaagtacactttgatcaaagactggaatagattcactagtgcattctggctaaacttctaacacctcaagtagtcacattttcaaaatagcagtacagcatataataaatatactgaatgaaactagacctcttattcaaccctattcatcccttttgtgatgagttattagctagattttaccccacgatttaggtgaaatctcaaacaagtcaaacttattcaataaccctcataatatatactaaaattagcacttttgcaaaatagtaaaatgggaatcaatcccatgatagaacttatgcacgtatattaaagttatattgcgattaacatagagtttattgggattaaggatagcaaggaatttatatgacaaatataaagagaggcaggagatcaaacctttttattaaatagcagttactaaatgccccagtacttcagaaccccagagcattctcaaacacatgttttctaataatattgttttatctcatctcaactcttacttcctttttgtctctactatgaaatgctaatagttggggtcaacatctgtctcaacaacgtccttaaactaagatttggcagacatatttatactttatacatctaagatgaaacaaaccctgccttaagaatattagcaaataaaatttgctgaatattaatttatttaaatcaccgaaggaaggagagtaactatcataaaaaaggtattcttttttaaaataatatcaaagtttacattccttttagaattattttagtcttgctgaacaaacacttatgaggcaaaatatgcataaagatttatggcaggatttcagtcacgtaaggcaataacacttcccccttattttactgattaaaagaataaaatagcccaggtggaaatttagagaatatttggtctttagacacacttgactgtatatggtaaacattttactcatcttccccagagtgaaaggataatattaatatttttaagtggtctttatcctttctttctggaacgtggaatgaagcacatcaataggtgaagctcacagaacagtggaggggtcagctcagaatttctcccctctcaaagccttccctaccctatcacatcattgcttaggcacccaggctaagtgacaatggtcagctaagcctctgaacgtggataagtatactccaagcggcaatacccattcacctctaacactaataagccctatgacataatgcaggtcattttccatcttttgccattggattctaatatgcaagaggtagaaacctatctctccgtttatttaacaatcactggcataccacttactgtgatcctaaactaaatatcacgtgcatttagcaataaaagggggtcttcaggcatactgatgaaaggcacaggcttttcagctggcttgagtgtagtctgctctttatacttccgtttctgtttctgtaaaatggaaataactctaaactggcttcacatgcttaagtgagcctgagatgagataatgcatgaaaagcatttagcattgaaacttgttacataagaagctctgacaaaaatattagctatttttatcattgaaaatatcaatgtgattactactcttgctacatatattttgtacatactatgtaattatgtaattctatatagtcttatagaataaaggaattagatttcatttcatgtttggataaattaaaagaatgatgagttcttgagtcagggaaagttattcaaaatgagctctctctctagaagaaagcctccagaaattcttggaaaccaccctgaaagtgaagaaatcttcttaaaagaacacctttgggggaaaaaatcttttttattaacattttcattatttgcaattgtagatctcaaggctaatgtatagtctctagaacaataaacatgatatggcagcctgaagcacattgctttggaggactaaaagcaactctaaaatccatggaagagtaatcagcatccttttggttgcatcctttctatcttatttttcatttgttctacccttagggatctttctaaagcttcttttgaagatgttgttcactgtagaatgggacttataattcaataggtttagattcaaagtagcttggaacactttgaagtgtgttgttactgctactttacaaggcaatgaaaggtctaacttctgaaaccacaggactgccttacatcttctttctactctgagctatgttacagcaaattaacaaagctggatgatatagagtaaatcagtgcggtgagaaaatattttcattactattaatgcataagttttgttctagaaaaatgcaaaagtctttattttctaattttgaatgtaaactagtggcatttcagggtgtagcagttcactaaaatattcactaaagtatttaaggaagctaaaatataatttgatctttccattttatgttctatttcagaatctgatgattactaaaattgaagaattattcaaattgattatgcgtaatcctacgtagaaaatctttttatgtaataaataaaatattgcataattataaatttatttctaacttcacattttgaagcatatcatggatatatatattttgtcatctgaatgttaaataaattaataagctgctcttacttttgttagaataaactctgagaatgtgaaaaatttttctgattttaaaaaccatttttgtatatgtgtgcctttattaatttctgttttttgattcaactctttctgaaattcatcttcataatatctgtttgggaaacatggtggaaaaatgaaaaaaaatgataaaagtactactgaacttgaaatcagatgacctagtcactagtttgacatatcacttaatccctcatagtcacttttgtaatttgcgagctggaaattatgataattttctcatagggctatgatgtaaacaaggggaaggttctatataaagtcacttagcaggaaatgtaagcagtaactcaaagagaggagatagtctgatttaataaaaatgtattactttgtactttcaaagggtaggtatggacataaggaaactatttctgtcccatttggtatttattgctttgaacagacactgaattttaatttatagtaattctaggaagggaagataagttctgtagaaattacataaataaagtggcctcattggcctttctcattttggtcattatttaggatcactcacatatagtaaaatgctgactaaatcctcttgacccacaaaaaaaaattcagtaaaacttccttaatttgaattagttaattcattgatctttgatagtaaaattggtataaaatgataaagattgggtgctatatatttaattaatagctgacatattccattatcccataatcattttagtagcatttcatcagaacatgcaaatgtctggcaaaacaagcatcctcctactatatttcctgcttgatttttgtttttactcagtataaatttcttgagatcctaccacatgttagcatttgattcaacaaaattgttacgaattatttctttatcacttgaaattaaataaaaccacatgtaattattgttttgatgtcaatctggatattctaatcacttttagaaatctggtagagaaattgaaacagaactacaagaggcaaggtttcatgttctttagaaaaaggtgacatattgcttcttgattatgtagccattgagattgcagtgtatttaacttgaaaataacttgtaaaatgtaattggtttttcatctgaactcctatgaacttagacttaatgtctaagaaaatcacaccctgttgaggtctagactttctgtggcaacttcagcagatgtgcaccagtagaggtaaaaataacaccttggaagtcagcagcattgatgaaaagaagccagctgactctgattgcacaagtctctgagtctctgaactaagtgatgaaaacatatgccacatattgaatggaatgttatgatataatgaagagtttcagatatgaggcacatttaaactttagtgaaatgaataaaatggatgttctgatgtatccaaagtctctttataaccaaaaatattctatcagattgaactcaggtcattgtttctcactgtttcaaggcacaggatataaaaatagtttgctaagtcttagctcagaaccttatatttcacagtgatatattctggtagtattttctcatcttggaatgaatttaaagagtagcaatctaatcatgtttcccactttaacaacaaaggaagtatctttaaattttatcaaaggcagaaatagttcagagtttaataatcctgtgattttaaacaaagcttcaatagatagacagtagctgagggaatgcaacttctaataatggttttcaccatggccagacattaggatcatctggttaatgtgagagagaaaaagcagctcaggcctctctcatgctaattgtatctatacttttaaaatcactgcaggtgattctcatagatatccagtgttaagaactctttctatattggaatcaaaggagatctcaggagtacatgtgttgtgaagacttatttgatcttcaactttagactctgacagggtactattcctaatgtttaaaaaaacaatgagatgataagccagacacacctactaatgtcaataaaatagccaaaggcatgaatgagtggggtaccggacatgagccagatatctaaatccgagtgtctcgaatttgtcactactgaacttgaggccagatcattctttgttaaggggactgtcctgtataatataggacatttaacaatatccctggcctctaaccactagatgtcagatgtcggttgtgcaatcaaaatgtctcaattttcctgaggggaaaatagctcttggctataaaccacaacactaaggcaggagaacaccaagtcaaagggaagaaaatgaacacctgaacatactatcactacaactgcaaagggaaaaaacattacaatcaagtaggctctggaaattacacagtgtatagcttaatgcagagaaaattactaaatcattatgtaaattactcaaaaatatgcagtcatcatcatcatcatcgttgtcagcattatagcccaaaactacctatgctcaagttgtgatcggaaaattctttttaagtgatttgttacgcttataacaactttattcaaaattgcccaaacttggaagaagccaaaatgtccttcagtagataaacagatatataaaccccagcacatctagataaacgatggtatattaatcagcactaaaaagaaatgagctatcaagctatgaaaagacatgcagaaattttaaatgcatatgactgaaaaaaaaaaaacaatctgaaaaggtcattcacttactgtgtagtttcagctctatgacattctggaaaaagaaaaagtatggagacagtaaaaagatcagtggttgccaagtgtagggggggtgagagggctgaataggtggagcacagaggatttgtagaaccgtgaaactattctgtatgaaagtataatggtggatacgtgtcattatacatttggcaaaacccaaagaatgtgcaacacccagagaaaatcctcatctaaattgtagactttgggcaattgtgatgtgtcaatgtagatacatcaattgtaaatgtgccattctggtggtggtgaggtagtgataacgggagtctatccacttgctggggagggggctatgtaagaaatccctgtactttctcctcaattttgctgtgaaacctaaaacggttctaaaatataaaatctatttatataacaaaaaatgatttgaggaatttattcatgagcatatgtgaaatgttaatacgatctaagtgttcactgtgtggtttggttcataaaaatcaccagtgtcactgtgaaatgattaaatacttcaatctcaattggcaaggatgatttcatcagaataaaatgatctgtgaaacagtctggtttcctacactgagctacagagataaagctacagagaatcttcaggcagtgagtgtaagggctgaaaatatgttaccttagatatagaggaagaaaatcttaaatcctgtcatatgagataaattgtttttgtttttgttttcctttttttttttttgagacaaagtctcactctgtggcccaggctggagtgcagttggcatgatctcggctcactgcaacctcctcctcccgggttcaagcgactctcttgcctcagcctctagagtagctgggactacaggtgcacgccgcagcacatggctaattttttgtgtagtagagacgcggtttcaccatgttgcccaggctggtcacaaactcctgagctcaggcaatccgcccaccttggcctccaaaagttctgggattacaggagtaagccactgcacttggcggagatacctttttttaaagagtaaaataaaaatagcccattgaaataacaaatacagtattactatgtattgttactttgcagaaggtaaaagagtattgaaagtattcaatgtccttttttaaaaatagttaagagaaaaataacataaccaaaactggattattatgttccataaatttattttttaaatggaacaggtttacataatgtctaaagccccaaaatgatagtcatgaaaattgcaatagaaaggcaagcacactcttgataagtttatcatgtcatattatccagagttattttattaccagttaaaattaatagaaatcagagcatgagctcttgtgcttagatggggaaatatattcaactttctgtctgttttacttactgcttatctctaaggctcaaaatagtgcctgggacacagtagacactcaacaaacatctgttgaatgaacaatagtgtgaatgtaaggtttgtcttgtgaggaaatatatcttaccatgtgtttatcattatgatttattgggttttgatacattaactgataactaaaaataaaaatatgacaaataaaaggcaactgttcacaataatacagtattgacgttaaatgtcatttttaaactgacaaatctcaagattttacaagatgatgattcctcatttgttggaaaagatgaggacaagtaaaagattttgggggagagcaaaattaaaaaaaagtatataggctgggtgcgatggttcacacctgtaatcccagcaatttgggaggccgaggcaggtggatcacgaggtcaggagttcaagaccagcctgaccaacatgttgaaaccccgtctctactaaaaatacaaaaattagccgggcatgtaatcccagctactcaggaggctgaggcaggagaatcacttgaatctgggaggcagaggtttcagtgagccgagattgtgccattgtactccagcctgggtgagagagcaagactccatctcaaaaaaaaaaagaagtatatggacataaaagttgtctacaaccaagtatggcactaatgataaatatatgaattcatgtgttgaaaattttaatatattatgtgaaaaaatagaaacactagacatactcttggcttgtaaatattttcttagaaatataatgctgaataaaggaaatatgttgctaaaaaataacaaaaatattgctggaaaaagtgtacactaatataatcacaattttttaaaaaacacaaaaagaaagtgttgctattacttaataaaacagggtaaccacgggtgagctaaaactactcaaattcccctgttaacaagggtcttgcttcttcttcctcaaattaaaattaacaaaaattagaatgaagaagcaaaaaaaatcaagtaaactgtcattgaatgcatatgctggtctgatttatgtggaagaaaaattctagctatggctatattttctcacttaggttgacagtgtgacactttttactaccacccctgcaagtaaggtaattctgccactgatgaacaattattatggacttttctaccttggttattctaactttcattttaaaatatttggctaagtaaccaaaaaaattaagatatcagatttacatgcaaaccctgaatacatttaattgtgcaatcagtatatacttggtgtatacataataaatgtatatataactctgataaaaacactagaatgttatctttctaagtcagatggagaatttaaacaatgttgacacattgaatatatctcaatatcaaagaaaaatataatttcattagaagtgagtgataaccagtatgcattccttgacgggcatttaatttcagatgaaatggcgaaaccccgtctctactaaaaacataaaaattagccaggtgtggtggcagggctcctgtaattccagctacttgggaggctgagccaggagaatcacttgaacccaggaggtggaggtttcagtgagctgagatcacaccattgcactccagcctggatgacagagtgagactctgtctcaaaaaaaaaaaaaaaaaagtcactgaaagtcactgaggatgttagttttcatttttaaacttgaaaaggagcaatgaagaaggccatgctaaaatgtaattattgttttaaaggtgtttccattgtttgaaagcatatgatccctaaaccagcatgtgagtttttgctctttaaatcagcccctccattgtgaccttcagaaagttgcgcaagaccagaaaaagtcttggaaataaatgttggtacatctcttcatatcattgtcctgggatgaagtgagacatgtttcagaccattgagaatatgtctgtttttctaccaaatgacaacatacaggacataatttatatgtgaaattataacacaaaaatagctcttaaaattgatcatgtaaaggaaattataagctttatcaaaatccaggagaacaccacatatatcatatacgtgtgtcaatctgctgagagattatcattgagtcagaacttcaaatatttaaaaatgttaaaaaaatgctacttgaatactttttggcacattcaatagaaataaaacagaactatatagactgaaatgataaatttttttaaaaaaaattacatccaggtttgtgataggaaaaattttaaagaaccacagaaagcaattaaacaaaacaatgacaggcatatttaatattattatgattgtcaatggaatgaggcataccaaagaaaatatctaaatatatgccacagtgtgattctacctccctgtataatatactgggggttttgacggaagggagtgattacaggagcacaccctcttgcctgcataccacctcgcacacactttcaactagtgcttcgctttctttctcacttaaaaccatatttagctaggccaggctcggtggctcacacctgtaatcccggcactttcagaggctgaggtgggtggatcacctgaggtcaggagttcaagaccagcctggccaacatggtgaaaccccatctctacttaaaatacaaaaattagccaggcatggtggtttgtgtctgtaatcccagctactagggaggctgaggcaggagaatcacttgaacctgggaggcggagattgcagtgagccgagatcgcaccactgcactccagcctgggcaacagaaggagactgtctcaaaaaaacccaaaaacaaaaccaaagaaaaaaacacatttagcaggtatttaaatatttaggttattaggtaaatattaggtaaatatttagacatttacctatctaacaggtaggaagagcaatatacagatatatatctatagatatagatatatggatagatagatatgaaaaacccaagaagattctatcaggatgatttctaaatagggcacccaaaatagcagctagaaaacaaatcatattaacttagaaatgacatggccaaattaaaatatagaaagtttaaaaaaaaatcactgcttatacaattggaagcaaacatggtagtgaaataactatatataaaatcattaagtaataagaacataagtgacagagtaaaaaatataaattttccctacctcaaacatttttcctcttcaatccagcctttacttttaatcagaagaatttttctaaagcgcaaaactaattacaatgtaggatctctcacatattttttatgggaatgcaaaatggtacagcagctttggcaatgcattacaaaactaaccatactgttgccatataatcctgccatcaactctctgatatttacttgaatgagttgaaaactgatgtccacagaaaaacctgcacacagacgtttaaagcattttgctaactgccgaaacttggaagtaaccaagatgtttctcagtaggtgaatggataaataaaccttggtacatctggacaatggaatgttagtccatgctaaaaagaagtgagctggaggtgatggggtttggggagagatactggtcaaagcacacaaggtttcagttagaaggaataagttaagaggtctattgtacaacatggtcgctatagttaataacagtgtgttgtattcttgaaaatggttaagagagtaggttttaagtgttctcaatacaaaaaaccatgtgaggtaatgcgtttatcaattagcttgatttagcctttccacaatgtatacatatttgaaaccaatatgtggtacaaaataaatatatacaacttttacttgtcaatttaaatcaatcaatcaatcaattggtaaaatgtaaatttttttttttttttttgagatggagtctcgctttgtcgcccaggctggagtgcagtggcgcagtctcggctcactgcaagctccacgtcctgggttcacgccattctcctgcctcagcctcccaagtagctgggactacaggcgcccgccactacgcccggctaatttttgtattcttagtagaaacgggatttcactgtgttagccaagatggtctctatctcctgagcttgtgatccgcccacctcagcttcccaaggtgctgggagtacaggcatgagccaccgtgcccagccaaaatataaatatttttaaaaagaacaaattgtgccataaagccatgaaatgatgcggaggaaccttaaatgcatattgctaagtgaaagaagccaatctgaaaaagctatatactacatgattccaactatgactttctgggaaagacaaactgtggagacagtaaaagaatcagctgtctataggggttgggggtgagggagggatgaatgggtggagcacagaggattttcagggcagtgaaacactctgtgtgatactgtaatggttgatacacaacattatacgtttgtccaaacccatagaatgtacaacaccaagaataaaccctgatttaaactgtggactttgggtgatgatgtgtcaatgtaggtttgttgattgtaacaaatgtaccactctggtgagggattttaataggaggggaggctgcacatatgtaagaaaaaggagtatatgtgagcctatgtaccttctgttcaatattgctgccaatttaaaattgctctaaaaaataaagttaacttttaaaaactaactgcaatactttcttctttattatcttgcattggtctcatccactcaacaaatcatgttcatatacttcaagatttacatgacgcatcagagttttgcatctacttaacctctccatcctgatctagcacacggatgactgcagtcctctatgtatttcattctacttcacatcttctgggttacttgtagaagttcgttctatcctcccaacccaagatcaagagccccttttactcactaatttgttaatagagttatacatcctttaaagaaaggaattcattttgagaaattcatcattaggcaatttagtctttgtacaaacatcctaatatatacttacacaaacctagatgtgtagcctactacaaacctatgctacatggtatagcctattgttctcaggccgtaaatctacacagcatgttactataccaaatgctggaggcaactgtaacaggatggtaagtatttgtgtctctaaacatatctaaccatagaaaaagtacagtaaaaatatggtattgaaagcctacaggaccaccctctgacacgtggttcagcactgatgaacacattagggggtgcatcactgtaattaaaatgtcctgtgtgcccacaatgtgtactgtactaggccttaggtgtctactagtcaacacttctttatcacagactttaatcccttctctccgtgcaaacactgtaagctatttgcatgttcatcaatatgtatagcatgcatgtcttcatgtacaagtctcccatgtattctgactatactagggactcccgagggatagggattctgttttgtttcttgatgaatcctcataactcaggatgacacatcaatccgtgtaacagatccttaaaaaaaaataaaatcgagccagagattttattttttcaattgaaaacaaaattcaaataaagtcaaattatataaaaaataaaagcattggacggccgtggtggtggctcaagcctgtaatcccagcactttgggagactgaggcgggcggatcacctgagggcaggaggtgtttgagaccagcctgaccaacatgatgaaaacctatgtctaccaaaaacacaaaggttagcctggtgtggtggtgcgcccatgatcccagctactcaggaggctgaagccggagaatcgtttgaacccaggaggtggaggtgacagtgagcagagatcatgccactgcactccagcctgggcaacaagagcaaaactccatttaaaaaaaaaaaggcatcatcttagtagaatatacattttttccagcaaatattactgcaaaggaaatttccatttggtgagtactaacaatataatataattttaatatcagtgatactgtaaatgtctgaaaaatgtactttttttttttttttgagacagagtctcactcagtcacccaggctggagtgcaatggcatgatctcggctcactgcaacctccacctcccaggttcaagcaattctcctgccttagcttcccgagtagctgggattacaggtgcccaccaccacgcctggctaattttcgtattttttagtagagaaggggtttcaccatgttggccaggctggtctcgatctccagcccttaggtgatccacctgcctcggtctcccagaatgctgggattacatgcgtgagccactgtgcccggactgagaaatgtacttttgacccgtgttcccaatacaataatgctagtcttactaattcttcagtgaacatttaactttaataccctcaaaatacttagtttccccataaagcaaccttaaaatataaactatagtagtggttaatctcaaaatgagaaacagagataaagaaatggagtctcaatatgttgtgaagcgatatcttttgtaaaatgttattgattgaaaggcagagtcaaaaaaaatgtagctcttgagttttttctgaaaataatttttcaatatctttgcataaagatttttcccagtacagtaggcatacgatttctggttgaaaaatagaggcactcatcaacctatcagttctttaaaagaccattaatagtctgtggttattatttcatccttactctagtggtctattttaataataactattacatgtttgaaactatctggcatactggaagggtagttgagctggaattagccaattttacaaccatattttccttgtcgagtgtcacctgaatgtgtaatattgagctaatcacattgatgacaacagttaatgtgaatgaatgtatccagattgttaccttgggagccatcaagtctaaaaagttgaggctgagcatttgctatccttgagattaattcctggctttattgcaaaatttgattgaaaaacctaaacctgcagatgccttcatttaaactatagtatatttgtaagtagaaattagaaattcatacgttatggagatatttccctaaactttttagagggcatcacattctacaatttaattttatattaacaaagttagaaacttcaaggttttaagtattctgtaaaaacaaaatagagagccatagagtattaaccttctatatacaggatgtttatcataaaataaattctttatgtaattatttttagtagaactactttgtttaggaaagcatgggtcagataatgtgtcatttcatgtgtttagtttttctttttcagtaaaagtattttagacagccttgatatgatgtgatgagaaagacactttatctctgtaaccttcctcctcataactcaaaaccccaatctaatcatgagaaaaacatcaaattacagccaaagtgcatttacaaaatgtattactcagccaatactccttaaaactgccaaggcctttgaaaacaatgaaagtcttagaaaatgttgtagttcttagtagtctaaggagggacaattaaatgtaatatggtatcccgaatgggatactgaaacaggaaaagaacattttacaaaaactaaggaaatcagaaagaagcatggacttttagttaacaatagtgtatcactattggttcattaattgtagcaaatataccatattaaagtagagtgtcagtcacagggcagactaggtttggtatatatggaactgtaccgtctttacctttctgtaaatctaaaattattccaaaataaaatgtttatttaaaaattactttaggattataaaaatgtaggcagtcacaaattatataacattatatcctagaacaatctgataggagaatatacaaattttttttaagttttggccaaagagtatatatcatgacttgaataatctaaaaaatcaaaaacaaacagatataaacaaaataaaatgttgaacattttgagaagttatttttattttaattgaatttcagtcacaacttatggtgatctgagaagcatccacatgttgcaaactttttatcaattttccatttctggctgttgtaagtctcttgtattttaaaatctaaactagatgctttacacagttttctattttatcaatgccaccttatgagactagcagaaaatttctttcaacttttacattagacatcagaaaaaataagaactttattttttcttatttatttcttcctacaatttatgtactagcatagttaatatctcaacagttacactgagattggtccactgtcctagtatttagagttcagttctgaagcgatatacgagatctacttcagatacttgcagcaaataaaatcctggcccttcttcctcaatgccacggtttttcaaacatttttttaaaatatcacccctatgtttgaaggagtctacacctcctacaccccaccccccaaatcttccttgctgagaaaccagttaaaatctggaaaaaaaaatgatgttgtcttaagtttctagaaagaggcaaagctttgttctaggaattctattcccacagtttaggattcaaacgtttatgtgtgtgtgtgtgtgtgtgtgtttattttaaaaggcattaaagtttagggatagtctagaatgcagagtttctttacaatacttagaaattcatcttaggcctccttagagctagtcatcaaaaagtctgttagtcacagaaaagcatcttagactaccaagttctctcacatcctgcagagcattcttgtatttgtgaaaagagacaattcgttattgttgataaaagcaaagattaaaatgaggacatctctgtaatgaaggagctttccaatgaccagtgaatgatcttactaagatgcaaaacagaaaatgactgctgagttataaaagaccctcgtaaacagataaccatcctattaaatgaactcaaataaaccataaaatggtagggaagccctaatcatgaggttagcggcatggactctgtgccagatgcttgaattcaaatctggcttcatcacccaccatgtaccccaggcaagtcagtcatcctctccaggaggcagcttcttcatctctgaaatgaggataattctagtatctacatgacatagtttatcagaggattcagtgtcctacaattaagcatagtaggtatagtatgggcatatataagtgcctaacaaatatttcccattattattactaaacttagtactaaaatttgattttaagctatggaacggagctgtgagttatacagaatagattttaagataattatacagagtatgtcttaaaaatactaatctaatatgctgtggccaaatctacaaacacctgaggctaataagacagatgttttaaactaaacaaatagaataagggttgaaaatcctttgtctgaaatgcttagggccagaagtgttttgaatttcaaattttttttaggttttgtaatatttgcattaacttaccagttgaacatcccaaatccaaataccccaaatctgcaatgctccaatgaacatttcctttgagcatcacgttgacgctcaaaaagtttcacattttggagcatttcagatttgggattttcagattaggatattcaaccttttatgtttctttatctctgaaacagggtaacaatagcaactagttaattttgtttctttaaaacttatatatggaagaacattactgttatcataagactgttatgagttgaattgtgtcctcacaaaattcatatgatgaaattctaccaccagtgtctcagagattgaccttattgctctttactgagttgaaaaagtaaaaaattaggtcactagggtgggctctattcccatatgactgctgtccttataaaaaaaggggaaatttggacacagcttttcaggcaggaagaacatcatatgaatgtgaaggcagtgatgggtgaaacttctataaaccactggatgccaaaaattaccagcagccaaccagaaggtaggggagaaacatggaaccgggtgttctttacagccctcaggaaaaaaaaaaaatcaacccggtgacactttggtctcaaacttctagcttcctgaactgtgagacaatgaatttctgttgtttaggccatccactttatagcactttgttgtggtagccctagcaaactagtaaacacacttccaaaagttattattgttttatttaactcttagagcaggtagatttatggaaaatacatttattgaaaattccatagagtttagtacatttgggaaatctattacttcgaaagtgttgcatttaaaaatctaaatttcagaagaagtatagataaattctgagatccataatgatgtcacagtagcaatcggaaatttgtagaaataagaaaattggggatgggggcaaaaaatatctcaagatttgaaaatgtgacacactgaaggtctcctaatttgcagcggaataaatatgttttggcttaaactttaataagaaaatatggttaaagaaaataaatacttctacattaaacttaaaaaggtcatgttcaatgtagtcaataacatgtatttgtactcaatttggtgccatttaatatttaaggtaaataaattttgttacttaaaatactttaataacttttcatataatgttttaataaagtcgttaataatgattttcaccctcaaaatttaatattgtggttttacgtgcctcaaattctggattttgaatgacagatagcattaaaatattgtaatgaacttgaattggtgctgataccgcatgaaaggaaacacagaatgcagaccaagttatgctttcaaaggcattcattaagtaaagggaatattgattatcactctccattcagtgatacaatgttgcttcattttttttttttttttttttgagacaaagtcttgctctgtcgcccaggctggagtgcagtggcacgatctgggctcactgcaacctctgcctcctgggttcaagcgattctcctgcctcagcctcccaagtagctggaattacaggcgcctgccaccatgcccggctaatttttttatttttagtagagacagggtttcactatgttgaccatgctggtctacgaactcctaacctcgtgatccgcctgcctcggcctcccaaagtgctaggattacaggtgtgagccaccacgcccggcctgctgcttcaaaattaattgcatttgtgctgatataatttcaattagtaaccatttactttttatgcagcagagagaaacagggatagaataacaaatttctgttagtattaactaaggaagatttttatatacttgttgcaaaaaaaaaaaatccaccctttagtattattcagtgttccaactagagctgcaccgatatagtaccttcaaaagcacagactcattcacagctacggaacacaggcaaaagaggttaacaggttcactttgaacataataaagtagaccgtaagatacaatctgcctacaaacgaaaaaaaaaaaaaaaaaaaaaaaaaaaaagcagcatcagtagagtggaaataagtagcaggagagggtggacgataaatctttcttttcccctcgatttcatggagctacaagtcctgcgtgatatgcaagctgaggtgggggtgtggaggaatggttggcagaggggaagggaggcagggttctgcagcgctggctgcagccgccactgtttacttctcagtcgtggagctagcccccttcgtgaaggcagtgttgggacagccagggtatggctcagagcctcacccgctgctctgctgtctctgcagaacgcagaagaatgcagctcctactcctgtctctgctctgctcattccggggtgtcagggaggtgttacaggagtgggcggggcatcttgctgggctgacaccctgctgcattgcctctggaggagcccacgcagcagctgctgccacccttctggtctgttgggtgggactggtgacacaattgttaccattatagaaaaaaaaaaaaagaaagaaagaaaacgtggctcatgttttgcttcgaaaattcctatttgaaatacctttaagatgcttgaatggcaggcagataaccaagtgcatctctctctatatatagatatgcaattcttccttgattgctttgtctttttattatgaagttattttcaaattctgaatgaaataacacaattgactgcactcgtcctggcagaaggttattaccttacggtaaagacgtgctttcagacccccttatctctttattttttcgttagggttttagaatcacagactcgttgagctggaataagctttagaaatgatcctcattttgtaaatgaggaaactgtgatccataaaaggtaagtaacttgccaaggcacaccagtggcattacaatgttactgttccaattgtaataaaaagccaattactatataactcaattcactatactctattgacagaagggaaatgaatcttaaaatcggaatttgcctttttactggagaaattgcttgggcatcactgaaaattggaccacaaattagtcatattttattttttcatcaatccaatatctctctgtaactaagtttccctggatctataattcgctattactgatttaaataatttcaataataaggcacaatttaaagccccttagtcacattattgggattccagttttactcctactcatatattttatctctttgggtgttacaataagttttgtcccaaactaaaaacagatgattcttataagaaataattccagagaccactacaaatacccacaactcaggcaaactatcttatcagattattgttgctgttgacaccaagaagcataataaaatgtgttagaaacaggttaaaataaaaaaggtttgctggtaaacaggcatttttgaacatttctgtgagattgaagtaatttacatcagtccttattagagacagcttacttaacatgaattatatgctataattagacacatgttgttacataacattagaaaaaaggaaaatatgtctgtcaagaatggaagcttcaacatttcattctagaaaaattattctgtataaaagtgcaaaagtactttcaaccttattatttttcattttcaccactcatgcattaatagatagatacgcattgtctgtattacaaaactgtagagtaagactataagtttgatttgccattaaatattatataaattaaaatttaatgctgaaattaatagaattcttaaattaatagaaaacagaaatcatatgatatagctgtcctcaaatttacagtaaaatacagagacatatgtttaacaggagacaggcacatgtattgcttataaattggagatgaatttttctgtgattctcaagagaatcacagagccctttggaaaaaaaaaaccatacatcaatcaacagtgttgctacctctagaaacaaaactagttgtgctacatagaatctgagtatttgaaactgaattttcacaaggaataatcttaatttcaaaaataatgttatcaagatttaagatagcatcacagaaggaaacgttactgtgtgaaaaaaaaatactttaattcttgggagatgaatgcaaacacctgtgtgctattgaaatcaatccacattaaatactgaatgtagagaactaacatacccaagcgctcacacatctgccacaagtggtgattttgaaatccccatagagatctttgatggccccagttgtgaagaaaccttccaccatcagcaaaatgccatacacaaagaacgcagctgcgatgccgtagatcacatacttaaagatgtcaatcctgagagaaaagacaaagtgatttatttcaataacttttcattgctgctgtgcagaaattgattctcacatgctcatgattcttttggaatgaaagttatagaatatttatattcataatgaaggttggatttaaaaacatgtttgcttcatatatctaatgtttatatacaatttttttgctgccacttccaatatttgttgacaagagatttaaggttttcatgtttgtcagtttcttcttcttttctaacttctcctcttccctggttcacaccaaagtaagctggaataagcaataaattatacttctaaaggaatttgctccttatttttatttagttatttatttatttattttgagacagagactgctctgttgcccagtctggagtacagtggtgcgatctcggctcgctgcaacttctgcctgccgtgttcaagtgattctcctgcctcagcctcccaagtagctcggattacaggcatgtgtcaccatgcccagataattttgtctttttagaagaggcagggtttcaccatgttggccaggctggttcaaactcctgagctcaggcaatccaccaccttggcttcccaaagtgctaggatttcaggctgagccactactcctggcctattcatttgttaagtagggtaattatcatatgatttctctaattaggacaaaataccaaatgcaaagatttgtgtatgtaacactggtttttaaaacttacattaaaagggaaggaagctttatacttaatgatgcagtagttttacataaaatgatacaaattccatatttttacgttacagatagtcaattatagttgtattctattttgtactcatcatacacatcatgtgtatttgttaatgataatgcgaataatgaaaagatatggttttacagataaacattgacaatgaagccatttaggtatactcactaatgaatattcagcagaattggatctgagccaagatatggcatacttttatagtggcatgggaaggtccttttcattttctcacaattgattacccagttttgctttttttttttaaaagaaaaaaacaccatgtggctaaaataaaacatttatctagaaaatataaaaatgtgcacagccagaactgatacataataacagatggatatatggatagatagatagatttaattcttttccccagctctgtaactaggaaatgatattcaataacattaagaacaattagttcatttatgaatgaagatcatttgcattcccatgttttgaaaacattcattccatacatatgctccaaataatatcttttaaatctgtaggaatattcatagtcctaggtgtagctagagttaaatactccattaggatttatttattttatatgtatatatgtatatatattatatatatatctgcatgatcagtgagcttttatattcaacgtagtaagagttgtagaaacagccagttaaatgcagatgtggcaataacaccaactgaatgctatgcaatagttgcttaacctaaaaaacaggttatatttaacactgggaatgtattaattatatacatttctttggatagagaccatgactttctaattaaaagttaatacagcaccaatatataagtacttgttgatgttaaatatttccttgagactgctgggtgaattcagtgagtatgaaacaaatttacactttcaataaacccactaatcttcctttgaacttctaatttccttcataattaagatttttaatgatttttcttcgtataatttccacttatttatttatttatttatttttcaagacatggtctccctctgtcaccctgactggagtgcagtgacacgagcatggctcaccgcagcctcaacctcctggactcaagtgatcctctcgcctcagcctcccaagtagtagagactagaggtgtgcaccaccatgccttgcaaatttcttcgttttttttgtagagacggggttttgccatgctgcccagattggtctgaagggatctgaactcctgggctcaaagggatctgatatggtttggctgtgtccccacccaaatctcatcttgaattgtagttcccataatccccatgtgtcatgggagagacccaccgggaggtaggtgaatcatgggggcggttacctccatgttgttcttgtgatagtgagtgagttctcgtgagatctgatggttttctaagatgctttcctgctgcttctcactgcacttctctctcttgccgctatgtgaaaaacgtgtttgcttccccttccaccatggttgtaagtttcctgaggcctctccagttggctgaactgtgagtcaattaaacctctttcttttataaattacccggtctcaggtatgtcttttatagcagcctgagaacggactaatacaggatctgccagccttggcctcctacagtgctaggattacatgtgtgagccactacacccagcctccctttaatttttgacatctctactagaatataagtttcataaagacagaagttttgatcatttatatcaactactgtatcttccactagaacgatatctgacaatgctggataaaaaactgaattgggtgggggcagtggctcacgcctgcaatcccaccgcttcgagaggctgaggtgagaggatcacttgaaccatagttcgaaaccagcctggtcaacatagagacaccccatctctacaaaaatttaaaaactagacagtcttgctggcagaaggctgtagtcctagctacgtgggaggctgaagctgcagtattgtttgtgttgaggaggtcaatgctgcaatgcgctacgatcacaccactgcactccagcctgagaaacaaagtgagaacctatctaaatgtaaaaaatgtgaaaggaaaaaaaaggaagtaatttaatcattaaattaatgtatgttaatgagtatcacaaaagagctaatgaataagataagtgtctatcaaaagcctcttaattcttagctatcattttcttagaaaataaatttgatttgaatcctccagatctatttaagtatctatcccatgatttttttcccaattaaaactggtcacatatatatcctttgtggctcaaacttaacttgtcaaattatttaagtaaatttcagcataccagtaccctatttattttcaacagtaattttttagatcaacttcaagattcatcaatgtaattttaatcgtttctaatttgcttaaatttcatagctcaaaaaactgcatttgttgttgtttttaataacataggaatatgttattaaatatgtacataaggaatgaatattatataatgtgtgaagaatgaacacatttttgctatgataagtaatacattttcattgtgtaactactgtttaggctataaatttggcctgaaatgttatgtttcggtaccattttggggaagtgaggggtttaacatcttcctccctcttggcaaataggttttctctacttttctatgtgctaacacataaacaaaaaaggctaagagaatttgttggcataagacaaaaacctctaaagtagggaatgattttcttgtagaggatttgtttggtagacaaaagtacaaatgaatgggggggaagaaaaaaagaaatttaaggcatagaactgaaaaaattgcaaacatgctaaatgggaagaatttggccaaaaaaagtgctttcaataattttcctagtttttatatgaaatgaattattgagggaaatccattttaatctctaaaaactaattattgctcagaaaatctttttccgatcattctggttctaaaaattttctgatgtaattaaacaaaagcattacactctcaaagaactagataatatctgctaaataaatattttagaaaagaacttataaacaaaaagcaagagcctatattaaagaaatcctgagataagcatatcaccatatccaaatgtaccagtcatgaaaaacgtggtcacagattgctagtccattgaataattctttcaacacaggaaacaatcgagcaaaaaagttttagcctaagtcagtcacatgatggttaggatatagctatctctattaaattattggacctcaacaatatttcttcctttagcacatgtattttatatatatggaaaaaacagcgtatacgtcttgagttcatcatgtggaagcagtcacttaatattttgaattccccactccaggccatacagacacacacagagacacactcacacatatgacttcacactgataaggcaaagaacatatggaacatctggaggagaactgtcaatggcattggagaaaagagaaagaatcttctgggagtaggaattttattgaagtgaagaaggggtcatggtgtgtggaaaagtatgtatattagctaaaggtctatttctgcagccttgatactgttttattaacaaattgttgtttatttcactttctcaagcttgaatttattttcttaattaattagagtacgactagaatggataggggtggcattaagtgatggagacatcctgtgattatatacaagagcaaaatgaggggatagaaagcttgattatgctgatagaaatctagagatcctgtgacaatatttttgaaagaatgcatgaaataggatttgctgcatagcagatgagagagagagaagaacttggtaatggtaatgtcccagagcaattgtttagtggctgactttcactgcctgaaagtctaaatattgcagaaatctatttgtcaaaggcaatgaggcagatgatgtgaactgtgtaaacctgtcgcgcatttgaaagaatctgaggatgtcaacttacagatcaaatttgacatcaagaacactttaaagagtgtttcatgggctattctatacaattcttttggtgaaaatggcatgttttctaaacatattttaattttttatttggaaataatttcaaatttacagaaaaaagttgaataaaacaagtagtatgtggagcaactttacatcctttctctgtaacattttatctcatttacttgattgttttctctggatgatatatctgaacatagagaacatcttcacagtgtatagttattgacctcaggaaatatatcattgacatacttatgtcaaatctttatttgtatttcaatttcatcaaccaactcaatgatgaactttgtgggatttctttcttgcctgataccggagccaatctaggggctactattatacccatttgctgtgtctctggtcttctttaatctggaacacttccactgtctttctgtgtcttaatgacatttatgttgttgaagaatataactctattctgccctttttgaacggaatgttccttttgagtttgtctgatgtttcctcatggttagatacgggttactcattcttggctagaatactatacaagcgatattgtgctcctgtcagggtatctccctcctcactcacacaaagcccttctgcctctcagtactaattttaattttcatcatctagttaagatgatgtctgatttctgtactgtgtactacttctcttccaactaacaagcgatctgtgaggagatactttaagaccaagcaaacatcttgctcccggtcaaaacttctccccaatgttagcaccccatccaatgatgagtattgccagacccaatcttcttatcatgtttgcaaaatgatgatttcctaactccattaccagctccacatttgcaaatagcactaggtattctgatgcaagaagagcccacccttttcccccatttattgatttgtctatttgttagtgacacggactaatggtatctgatttttttctcaaggtttaaatgccattacaatagctcattattttggtactcaaatttttctagacttgagcaataggaatcccttcaagctggttcttgtatctttgtgacatgtgcctagcaatttgtaagaatactccttgctttctcacatagcaagatgctccaggctcaccttgcacacacctctttcaacctcagaaacaggcatctctttgagaaactctcgtcctattaaagagcaatggtattcgggaccaagatgtggtgctatatgtgctcattgcaaatgttgtgtctttacctttaggtctttttattgtatcaaggtaagaaacacatgtatgtatacacacacacatcaatatatgcaactatataaacatatctatatatgtgtacatgtatgtgtgttcatatatacatatatatacatgtgcacatgtaactgcataacaaatatacacatattttagaaatattgagtatacagtgatacctccaaacccagtctatcgctacagggatttttattgctttcctcctttgatatttgtacgtctttcttccataatgagaatactgactcccaagaatattaacacgtttattctttggtttaattccataataaatctaaaattatttcagaattacttattcacctcattacaaaaatcatatctatctagaaagagttcttgtggtttgcaatccttcccacaccttgcccaagactgagactatatagtcaatatactgtgtttctaagttacatggattagtgtattttttcttcccttcattgtggccatgttaatgcaactgtttgtttcagtttcacgttgtccatctcatccatattgacttagtttcatttttggatatacaggacattaacatgcttcttaaagtcaaatctatacaaaagacatatccagaaaagtggcaagacttttctatcctgtccgtcctgttccttgtaggtaacccatttcattggatccttgattatctttactgtgtttttatgtaaaggcaagtgtgtgcatgtttgtgtatatgtctattttcccttctttttacatgaaatgtgcatactccatatattcttcatatatactccatatattcatacatttgtactttgatcaatgaacaatagtctttgaaaatttctctatacaaattcatagagattgttctcattctttttaacttgcatactactccatgtgtatttacacactatcatttattcacaaaatctccaatgcttacttatatggttattgatatcttacagttagaatattgcagcaatgaataactttgttcatatgtattttcaaataattgaagatgtatctttagaattaggatgggaggattgttgagttggaaattaaagacatatgtagttttgttacgtattgccaattcctctctataggtcttgtaccattttgtattccaaccagcagtatattagaatgtctgtttctccccatcctcaacagaagaaagcattgttaagcttttaaattgttgctaatctgatgggtgatgagtggtatcctggtattgctttatttatcttaggtattcatgaaattcaacatcttttaatatgattatgggcactatatatctttttatgaattgtctattcatgtgtttgccattttaccataagatttgtggtcctctctgcaccccataatttttaaaagatctctataaataagggatattatacttttgtctgttgatagtttagatatttgtccttgcctaaacttcatgttgattgtaatccccaatgctggaggtggggcccagtggtaggtgtttggatcatgagaacatatccctcctggctcggtgctaacttaagagggtgtagcacctcccctccaactctctcttgctcccactctggccatgtgatgtgcctgctcccccttcaccttctgctatgatggcaagatttctgaggcctccttagaaaccaagcagatgccagcaccatgcttcctgtaaaacctgcagaaccatgagccaattaaatctctttactaattgcccagtttcaggtatttctttatagtaatgcaagaatggtctaacagagaaaattggtactgaagagtgggacattgctataaagatacatgaaaatgtgaaagcaggtttggattgggtagcaggcagaggttgagagagtttggagcgctcagaagaaaacaggaatatgagggaaactttggaacttcttagacactgattaaatgattgtgaccaacatgctgatagtgacatcgacagtgaagtcaaggctgacaaggtctcagatgaaaatgagaaacttatagggcactggagcaaaggtcacacatgttatgccttattgaagaacttggctgcattttgtccatgtcctaggcctctgtggaagtttgaacttcaaagtgatgatttagggtatctggcagaagaaatttctaagctgctaagtatttgcatgggtgcttctaacagccaatgctcagatgtgggaagaaataaataactttaaatttgaaataatatttaaacaggaagcatagcataaaagtttggggaatttacagcctgaccatgtggcaagaggaaaaaaaaagttttctggagaggaattccagaattcaagcaggacgtggagcaatctcttgctagagaaatatgcataacggaaaaagagcaaagtactaatatccaagacaatggagaacaggccttgaaggcctttcagagacctttgtggtagcctctcccatcacaggcccagaggcctagaaggaaagaatggtttcaggggacaagtccagggccccactatcctatgcagccttgggacactgttcttcacatcccaactgctcatgctccaaccatggctcaaaaggcaccagatacagcttgggctgctgcttcagagggtgcaagccataagccctgtcagcttccatggtgtgctaagccagtagatacacagaatgcaagagtgaagaacacttggcagcccctgcctagatttcagaggatgtatgagaaagcctgggtgcccaggaggaagtctgctgcaagagtggaggcctcacaagaacctctgctagatgcaatgccaagcagaaaaagagtttggagctcccacacagagtccccaccagggcactgcctagtggaactgtgagaagtgggtcactgatctccagaccccagaatagtggatccactggtagcttgcactctgtgcctcaaaaatatgcaggcacttaaatcctgtgagagcagccacaggagttaaaccctgcaaagtcacaagggtagagatgctgaaggccttgagggcccatcccttccatcagtgtggcctggatagtgggacacagagtaaagattattttggagctttaatatttaatgactgccctgctgtattttgaacttgcatggggcctataatatcctttatgtcagtcaatttcttccttttggaatgggaatatttacctactgtctgtgtctccattgtatcttggaaggaattaacttgtttttgatttttcaggctcacaagtagaaggggtttggcttgtctaagatgagactttggacttttgagttaatgctggaaagagttaagactttgggtgactgttgggaaggcatgattatattttgcaacatgagaaggacatgagatttgggagagtccaggagtggagtgatatagttaggatatttgtccctgcttaaatctcatgttgaattataatccccaataatgaaggtagggcctgatgggaggcatttgggtcttgggggtggatctctcatggcttggtgctatcttaaaagtgtgtaagtgtgtggcacctcccctttaactctctctctctccctctcttgctcctgctctggccatgtgaggtgcctgctccctctttgcctcccactatgataggaagattcctgaggactgcccagtaatagatgccactatacttcttctatagtgtgcagaaacataagccaattaaacatatatacatatactttttttttttttgagaaggagttttgctcttgtcttccaggttggagtgcagtgatgtgatctcggctcactgcaacctccacctcctgggttcaagcaattctcctgtctcagcctcccgaattgctgggattacagccgtgcaccaccacactagctaatttttgtatttttagtaaagatggagtttcaccattttggccaggctggtctcaaactcctgacctcgtgatccacctgcctctgcctcccaaagtgctggtattacaggcatgagccactgcacccggccttacattttttaatatatatacattattcagtcttagttatttctttatagcaatgtaagagagggctaagacacaagtgacagatgttacaaatattttcttctagtttgccatttgtcttttggctttgcttatggcattttactatgcaactttaaaaaaagagaaattatatgttgtcaatgttatcagtgtttatttttattacatctcatctgggattttatcacagttagaagcctttacctacacccagaggaattcacccatgccttcttctagcatgtgtccagtttcattttattatatttagacattggatcaatttaccattttttctttgggtggcacaagaattgataaaatctaattttatcaaattagataaaatcagataaattagataaaattagataaaatcaattttatctaaaagataaaatctaactttatctttttttcaaaatggctgtccagttgttccaacatcatttattcaaaagatcatctttgctgcaatgatttttaggtctacttctgtcatacaatgaatttctatatctagatttatctgttcggtcctttccattctgttccataaatctgttcatttgtgtgccagtaacacactgttttaatcagaggggctttacgtatgtcttaatatcttgtaagattagatctctcatagctctcccttctttgtattttcttaactatttgtgtgtgtgtgtgtgttttgttttgttttgttttgttttattattatttttttttgagacggagtctcgctctgtcgcccaggctggagtacagtggtgcgatctcggctcactgcaagctctgcctccaggttcacgccattctcctgtctcagcctcccgagtagctgggactacaggggcccaccaccacgcccggctaatttttttgtattttttagtagagacggggtttcaccacataagccaggatggtcttgatctcctgacctcgtgatccacctgcctcggcctcccaaagtgctgggattacagacgtgagccaccgcgcctggcctatgtgtgtttatttttacacatgaactttaggatgttcctctttagcactattaaaatgtccattgacgttttattagggtatactgaatctattcattaattttgagagaattaacattttgataatcctcaacaagaatgaagaataccttttcatttgttcaaatctacttttacatctttgaggagtgtttcacagccaacttcatgtaagttttgaacgtttcttgttaaggtccttaatttacttttttggctactataaatcaagtttacctttacctttaaaaattcttctgtagctatacaaatgttcctgatttttacatgtaaattttatatcctactatgttgctgaattctattattattggaattggcttaatcattggtcctaacatttttcaagtatctcaccctgttacctggaaatagagggagttttatttcttgtttgccaattatcatgttttctgtttagaacaatggtttaagcagagattcagagaagaggaggagaatgaaaagcagagattctagccttctttgttcttgactttagtgggagtgtctcattgtgtaatattctgggtttagagttgtgacatttttatacacccccccacacacatatcatacatctcttcttatcttcccaaaagcttattggcaagcagcatttttactaacataacttctagattgaagtaaaaatgatcattaaaagtgtgtgtgtgtgtgtgtgtgtgcacgcacacacatttgtttttgtttcaggaataggcttagaaatatgctttctttttgtctcgtccacatattccaatgttccaagatgctgcttatgctcacatggattcttcccatggcaaaaagcaggaaatcagatgtgcctccagtaaaactacacaggcaggcttactttgtgcatttccaaaagtttctaacatttcaattcttacaaaaagttgtcacaggcagcaattattgcaagagcgaaaatgaaccttgattactgtggtcagctataaaaaacctcacttcatacatttatttagattggtgcaaaagtaattgcagttttaaccattactttcaatggcaaaaccgcaataactttgcaccaagcaaatacttcctaatccctgacacctatgaatattacttaacatggcaaaggagtgaatattaactttcatggcataaattgtgattgaaaatcttgacaggagaagcttattctgcattattcaggtggggcctcaatgcaagctcatgtttccttatgagatacagggagggggttcagagagacacacggaagaaaagaaggtaatgtgaagacggaggcagagattagagtgctgtggcctcaagccaaggaaggcccgcaaccaccagagtcaggaacaagcaaggagcagaatttcccctaccaatctccgggaagaggccacccttgctgacgccttgacttcaggtgtctggcctctccaactatgagagaatacatttctgctgttttaagccaacagtttgtggctatatgttatggcagtcacagtgaactaatatagttgactaattaattattacatctttttgttctgtatgtaaagattgcttgaaacaaattctgacattgtctaatgcacttgtatgctacaagtcatttattagaacacagtggtttgacacacaagttgctagagtatgcaatatttctttagagctggaaaatggcaattttaaaaagtaagaaatgcctgcttcttcctaagcactgaaaaccaaacattcctgagtaaaaatgagtagcttttctagtctagtgtatagatatattgaagttgatgtttccagttgcttctctaccagacttcagaacagagtatctgcaattttgcaggctatattgaagctactttagaatgtttagggttgtggtaaaggaaagtcatgtttcattattttttattgcagtaaataacacagaatatgggatttactctcttaacatatttttaagtgtacaatacagcattgtcaagtataagcacaacgtggtatagcagatcattcaaacgttttcatcttacaagactgaaactccacactcattgaacagccactccccatattccccaggccacagccctgacaaccaccattctatcttctgcttctataattttgaccattttagatagttcatataaataaaattgtgcagcactatccttctgtgactggcttattttacttagtgtaatgtccttgaacttcttccatctagtatcacaatgacaggatttcctccttttttgtggccaaataagattacactgtatgtatatactgtattttctttatgcattcatctatccatgtacattttgtctgtttccacatcttgaatactgtgaattatgctgcagtaaacttgagagtatatgtatctcttcaagatcctgatatgaactcttttgtattaatacccggaaatgggattgctggatcacatagcattgctaattttaattttccaaggaactgccaaactgttttccatagtggctgcccaattttacattcttagcatcagtgaacactagggttcaaatttattcccatactcacccacacttgttattttctgtcttattttgttgtttgtaatgggcatccttataagtgcgaggtgacagctcattatggttttgatttgcacttcccagatggttagtgatttggaacatcttttcatatacctgttggccaattgtaagtcttctttggagaaatacctattcaagtcctcatttgcctattttttaattgggtatttttgtttttgtttttttgctattgagttgtaggagttacttatattttttggatattaattccttaccagataaacagtttgtaaatattttatctcattctgtaggctgccctttcactctgttgactgtttccttttctgcacagaagcttttcagctccatctagtcacacttgtctattatttttgcttttgtgacctatgacttttgtgtcatatccaagaaatcatcaccaagatcaaaggtatgaacttttctcctatgttttcttctagcagttttataattttaggtcttacatttaaagtttaattcattttgagtttatttttgtgtgtggtgtaatataagcattcaatttcatcatattgcatgtggagatccggtttttccagcatcctttattgaagagactacctatttgtcattgtgtcttcttggtgaaaattcggtgatagtatatgcttgagtttatttctgggttgtctactgtgctatggtggtttatgtgtctgtctttatgtcaataccagactctagggttcaacagcacagtagagtgactatagttaaaaataatttatttcaagatagctagaaaagaatatttgaaacatctccagaacaaagaaatgataaaaatttgaggcaatgggtatcctaattaccctgattagatcattacacattgtaagcctatatcaaaataccacatgtgccccacaaatacgtgtaattatgtaccaataaatacatacatacatatatacatacatatcaaactgttggtttttgttattttctgttttttgtttgttggtttgttttttagagacagggtgtcactctgtcacctaggctgaagtgtagcggtgcaatcatagctcaccacagcctcaaacctctgggctcaagagatcctccagtctcagcctcctgagcagcttggactacaggcaggcaccaccatgcctggctaattattctactttttttgtagagatagggattacgaacgcactgggattacagtcatgagccacaatgcctggccaagattgttttgattactgtcaatttataatgttttgcagtgaagaagtgtgaagtttcacttttattcttctttctcaagattgttttgactatttggagccctttgtgattccataagaattttaggatttactctatttctgcaaaatataccattgtgattttgataaatatagctttaatccacaaattgccttggttcataagaacattttaacaatattaagtttttcagtgcattatatgggaagtctttccatctatttgtgtcttctttaatttctttcaagaatgttttacaatttccagtgtacaagccttttccctccttggttaagtttatttatagcgtttttttttttctttttgaagctattgtaaatggagttgtagaaatataagttcaaccctcttaaattttttaagccttgttttatgagctgatgtgatatttcctggtgaatgttccagctgcacttggaaagaatatgtactctactccactgggtggcatgttctgtacatgctgttatgccattgttctatggtgtaattcaagtctctgttacctgtctggatattctatccattcttgaaagtgaggtattgaaatctcctactatgattgtgtcactgttaatttctcccttcgggtctgtcagtgtttgcagaacaatgtttgtgaggcttctcccaatttcactgagatgttctcagaagccgccaggtatctacactaggctagttctgtcactgcttagaatgaggtgagacagaaaccagtccctcaaccaaccctccaaaaagccagagcactgggtgtgtgttctacccttctggtctctttttctcccagtgctgaggtgagctagcttggaagaggggctgatgtgggataaataagattgctcttgtcccctgtttcaacatggctgttacgggctttgtgctcacctggagtactgcaaactcttaaggggattctggaaatctcataaaggtattggtctgtaaattactgttgaattgatgttttatgggggacaagggctgggacataccagtccaccaacttgctgacatcacttatctcaaattcatatttcgttcaattgaaacatatgagactgcaaggtgtggcatctatgctagaagtataattgtaaattattggtggcaattatagcaaatataaaccttttgattttatcttttcaaactttaactcaaacactctgtaaaaatacctggcaggaaatgctgcaataaattagcctaagttatgtgttaatttcctatgactgttttatcaaattaccacaaacttggtggctttttaaaaaagacgcattcttatgttctggaggtcagaagtttgaaatcagtttcactgggctgacatcaaggtattggcagagccctactccctctaaagacttggagaaacttcccttgcactttccgactttcagagtactccattctgggctttccttggctagtggcctcttctccttcttcaaagccagcaggtagcatcttgttttagaagtaacactgccttcttctctggtcaagtggctctctgttcccctctcataaggacacttgtgtggggatttggggctcatccagataatccaggaggatctgctcacctcaggattctgaatgtaatcacaacttcaaagtctgttttgccataaaaggtaacatatgatgttacaaggattataatattgagggccattatcagcctgtcacaagctatagacttcattgaagttgaatgctaattccttgaccttcaaatattcttaggtaaagtttttcttcaaacaatgtggtgatggacatgtgctaatgttacattccaaaatccatttcaaaattttaaatcatcaaacatttaaattataataaacctgaggtatcttactgacttaattctcttctttgtcacaaaagtgtccttttatcaacatgcaatatataaagttaatagaatacataacttcaaatattaaattaggaaaattaaactcttacttatctacgtgaggatgaatttttgtcagtgatatatcacaagatgcataaataatcctctgacgaagaagtcactgattatgaagtcacagaaggatcaaatagagaaatagcgaagaagttttacattcactacttttgccttccaaaacaatcatccatattatcctacttcttaagggattaattcacttactttacctccttcctaaatgtagactttcagactttgttacacaactgttttactaattgtaaaagcaatatataagcattgtaaatttttttaaaaagcatataagaaaaatgcagattattcactgtttatactaccagtttttaatttattttaattaattccacaaagctatgcttactatataccactttgaaaacttccttttaaatcaatatattatgaatattttaaactattatatacctttttaaacaatgtttaggatatgacacattctgtcacttgaagatatcatgatcgattttaccaattgtctacttttgttcagtggtaggaagactgaagggccccagtgatgctcacatcattatctccataacctgtaaatatgtcatctcatatgccaaaaaggatttggagatgtgattaaattaatgatattgaggtgaggagattaccctggattatctgggtagccccattgtaatcacaagaatccttaaaagtaaaagagagaggcgagagagacagggtcaagttcagagtgagatttgaagatgccacactgctggctttgaagatggacagggaccatgagccaagggatgcaggtggcctctggaagccaggacaagcaagagtacggcttcttcctgagagcctccagatggagcacaattctgccaacaccttgattttagctcatttcagttagcccagtaagacccatttcatacttgtgacctccaggactctaagataatacattttgttttaagtaaccatatttgtggtaattcttttttgcagcagcaatggtaagctagaacttgttattaaaaacagcatggcaataatgataatattatgtaatatttgttctcagtctagatttcttccctgggataaattcctagaaaaaaattaatgtacatatggtcaaaatggtgtccagaaagtttgtgccaaaatgaagatgcattaataaaaagcaaaggtcttactctctctttgttccctaatgctaggtattataatttatttttttctgataaattgataggttataaataatggtatcatttaaaattacttttctgagtttactagtgaggatgaacatatgcttacaagctattaagcttttgtagtttttagtatacctgtttttatattttccctgtttttagtgacacattttgctgtagatgtagcaatttttcttttataaaattaggagctcttttcatgtaagctgcaaatatttttctcagtttttttaaatacattttaatgtttttataacacttcaatgaatacaattttaatttatagtatgtcaaatacataaatattttcttttgtgatttactatattgcttgtatccttcttaccccatgataaagaaaaccctaatttatgtatttgtctagcttttacaaattagcttacctttaaattctaatttttaatgcacctgaaaaattttggtaaaatataaagtaggaacatagtttcatgtgtatttatgagtacttacatggacttgggtctctttttacctttatattctgctccattttatatatttttctatgtctctgcaaaataccatatagtataatattaattaccgcagcttctcaattccctgtatttgtttagcttgatgaaacctataactctgttaaagtactagctctaccattctttatttgtatctgattagctgatgtggatggcacttttctcacatacctttcatatttcagtgctcgaagacaaggaatttgtcttgctctgctatgcatttctaaagatgagcacagtgagtggcacgtagtatcacctaagtttttttctgaatgagtacattcattaaaagattaatcagacataagattagcctaaatatatatatatacacatatgcatacatatatacatatatatataaaatatacatatataagtatatatatatttggaaacaggagtattatagaagtataataaatacaaatattttaaaatatattttcatacttgaaattcatgattgctcaatttgtgaaacatgaactattactaagatagctattcttgagttaacaagactaagtgaattacagactgtaagcatttcagaactacaagttcattaccatccttccctaaacactttaattgataagcaaatcacctcatttcaaggtagtctatgtattcttttttgaaaagatttttggaaagttctttatatgatgccaagaaagtatttctctataaattgaaatacttcggcttaagtctctttctctctgaaccataaagaacaaagcaagttttcttctatctgataactgttcaaatattattggaatgaaactatcgtgttcttatttatagatatgtttccctaaagttgctatgatatggtttatatctgtgtccccacccaaatctaatgtttaattgtaatcccgaatgtcagaggtggagcctggtgggaggtggttggatcataggggcagtttctcatgaatggtttagcactatcccctcagtgctattcttgtgaaagtgagtgagtgagttacggtgagatgtggttgttgaaagtgtgcagcacctccccctactctctcttgctcctgctctggccgtgtaagataggcctgtttcccttttgccttccaccataattgtgagtttcctgaggcctccctagaagccaagcagatgccagcatcatgctttatgtacagcctgcagaactgtgagtcaattaacctcttctttctaaattacccagtttcaactatttctttatagcagtgtgagaatggactaatacagaaaactggtaccaaagagtggggcattgctataaagatacctgaaaatgtggaaacctctttggaactgggtagtaggcagagcctgtaacagtttggagggctcagaagaaggcaggaagatgagggaaagtttggaactttctagacacctgttaaattgttgtgaccaaaatgctgatagtgattatgtacagtgaagtctaggctgaggagttcttagatggaaagaaggaacttactgggaactggagcaaaggtcacttttgttatgcattagcaaagaggttggccacattatgtctctgctctagagatctagatgatttaaggtatctagtggaagaaatttctaagcatcaaagcattcaagatgtgacctggctgtttctaacaagcttgtgttcatattcacaaccaaagaaaggacataaaaatggaacttatatttaaaggggaagcagagcatacaagtgaaacattctcagcctagccatgtggtagaaaagaaaagcccattttcagtggtggaattcaagcaggctgcagaaatttacataagtaaaaagaagccaagtgctaatatccaagacaatggggaataggcctcaaaggcatttcagagacctttgtggcagcccctcccatcacaggcccagaggtgtaggaggaaagaatggtttcaagggcctggcctgaggtccatgctactctgcacagcctcaggacactgcttcctgcatcccagctactcccactccagccatggctaaaagacccccaagtatacaactcgggccactgcttcagagggtgcaaaccataagccttggcagctttccttgtagtgttaagcctgcaggggagcagagggcaagagttgaggtttggaagcctctgcctagatttcagaagatatgcagaaaagcctagatgtccaggcataagcctgcttcagagttggagctctcacagagaacctctactagagcactatggaggggaaatgtgaggttggagctcccacacagagtccccattggggtactagctagtagagctgtgaaagagggctaccatcctctagaccccagaatggtagatccaccaccagcttgtcttttgtgcctggaaaagccataggcattcaacagcagcccatgagaacagccacaaggactgaaccctgaaaagtcacaggggtaaagcttcccaaagcctgggggggcccaacctttgcagtgtgcccaagatgtgagacacgaagtcaaaggaaattattatggagctttaatatttaatgactaccctgctagattttggacttgcatgggggcttatagcccctttctttcagcttttctcccttttgaaattggagtatttacccaatgcctgtaactcaattgtatcttgggagtaactgacttgttttttattttataggctcataggtgaaaggaactggcctcatctcagatgagactttggactttggatttttgaattaatactggaatgaattaagaatttgggggaacttaggggaaacataattgtatttggcaacttgagaaggacatgagatttgggagaggcctagggcagaatgatatgatttggatctggtccccactcaaatctcatgttcaattataatccccattgtggggactggtgggaagtgattggatcataggggtggtttctcatgaatggtttagcaccatctcctcagtgctgctctggagatagtgagtgagtgagttgttgtgagataattcacaataactggttgtttagggtatgttcagggacaaacagacttaaggcagcatgaaagtaggtattaaaactgtgagtcagtttcagagtagatgtcattattatcataaccactatcacccccactatcacatcataataataaacacttgtatagtgcttactctgtgccagccatgttattattgttttgaaatatcaactaattatcaactaattttattgtcatacaactctagaatgtaagcagcattaatacatcccttttactgattagttactaaggcaaagaggttaagtaacttttccaaggtaagaaagctggaaagaagcagagacaatatggaacaagctcaggggagtttgactccaaaatcttattcaccacactatcttgtctatctaaattcctcatggttcaagtatttggttttgttcttgttgttatttcatattggtgttttgaggtttttaaaaacacccatttgaggagtactaacctggctgaaatattgcctaatgaaatgcacactatttattatttcaaaagttaggaattcagtatggttttctaacatgagttctagttatgacttacattatgtttgactccccaagaataatcaataatcatacatcaatacaaatttggcagatcttcaaccattgttggagtagaattcttcagcaattaggtttaattgtcaacaacctagttcagtacaggcagtttacacagtactgtgattcatgttagcctatgaaactttgttttttcttgctattaattcacagttttcccttcttacactcatccattaagctgctaacaactgtttcctacttcattaacttccaaggagtaaacgtaaactacaagcaaacttagagatataaacccacccgaagttagttgagaacaaaatctatatatctattttgtctgagcttactgatttattttgttttaggtaaataggaactattttatatgtgcatgcaatattaaagaattcactaggtagtgaactcagtttttgatgtgttaacttgaaattacagtcattaaaaaattaataaaattttgaaaataaaatattcactctagaagaccacccaaatacagtctttatcttataagctacaggagggcatgcttatgagtaagactgttccttgcccagtcctttggagagctattcaaaaagccaagtcacttagcaaaattagtggtttggatttctgtatgatatctaattttctaacagtctccatattttattgtcccaaatgaatctgcttcacagaagcaaaatacctaccctacttcttacttagtttgtcaaatgacttatgaagcacagtaataacacctttccaaatgtctctcaagagaaagtctgaatcacaatttttctgatgaaaaaaatgtcctcctcatcacatagcagaaagcggcagagctgttttgagtgctgagtgggcctaaatggcaatgctaaaccaacagaagttgtgattagagtgtagaaataactcctaatggataagaagttgcacacttcttatcaaaacagtttggaactaacaaatgacctggctttgagaaactaagctgaaaattaagggattaaaagcttctggggaagaaaatagacaagagacagagaagtactaaaagttatacaaatgactataaatgagttatataaatgagtaacaaaatctttgagaaattctttgagaaatacattcttctctctctctggaggttgccacacctcaaatgtaatgggacaaaacagtataatgggtgatatcagctaagagtttaggagctcaacttcaggccagctcccactggcaggggctgatagtatttagaattatatgtctaaaatacagattacataagaatgaggattatttgcaagctcatttatggtcagtatggtttgcattctggacaagtgattagtgaaaccgaatagtcacacgtcattgcgtttgctgttgcctttcatgtctccctctggacttggaaatattgatcatgttgagataagtgtatgtatttaagagaagggagatagtggagagaggaaaagagagggagagagaaattttgtggtccctgagataaagaagtaggtaactcctcaaatcctgagcaccacagatggaagattcagggcttgggcaactggaactggttttatcttttagttcacacatccagtaaacaagcttcttttccaagtatataatgtaggagtgatgaatttggttgaactaagtatgagaactatggagaaaagaaatagactctgtaaattactaaaattaggtaagtcttttctccacaattatgctcttatacattcttttccaaacctaccttagttgatttccaaggagatgtatggcctgcaaacgaatcattcagcctcctctgccttctgtttgcttattttacatcttctgtttcctcagcactttttccattcctctgataccccgtaaggcagccctgcatagcgtaatatctacctcctcgaaacctttatgtaatctttaaatttatcacttggcactaatcgtattaagaggtttacagtacatattttccctctgtgttttcatgaactatttgttggtagggagagagtctcaaatactttgttagctctgcagggcctgtataaggaattttagtaatgtgaaatatgaaaacagagataattttgacatttacttttattccaatcaaaatggtattcttcccattccaaacatgcattattggtttcacatttaatacataatataacagagcaaaggtaaaactaccaaattaagcatataatctccaatctttcttctaaactcccctcacccctacatacactgcctttagagctttagtagatctctacaatatatgaaagtttgttgtttaaatatcaaatatcttaacaaataattgctgatagatgtacataagcatctattgccattcattaggcttatgatttcttacaaacttgtaattctataagtaaatttagcaatttggatgtagtttacatagagagaatctgtagatgttaaggacatctgtgatggtttaaaataatgcacagtgagaacatattttgtccagggtaggctgagataaatctagaaaatgtcagttttatcacattaaaatatatccatgcaatcattttcttaagactctctaaaagctaacctgcaataatctagagcattttaattatattccaaatgatgaatatgacttataatctttaaagggttgattcatgctatttgaatctaaggcattgatagctattgaattttggttttatacataggtttgtatttagtttgatgaaaactgataaactgtctactaatgcttaaaggattcaatttaatggataacgtcaatttttcagaactaattagtaaaataaatttacattgggaaatataatatgcaactttcaatttgctgttaattcttcattcccatttgtcatgaccttagcgaagctctcacttgatactacagagttatggactatatttttataataatttcacttcttaatttagtagctaatcagttccattcttctaatccccatgtatgtgtggggggtggaggggactgggttttctcaatctcattttcctcattttatttcttattttcttatcagtctttctctaggttttaagtatcaacaggttttaaataaacaaatatttcagctttgcttttactaaaaattttgctatgtactctgtccaggggtatatgttgtccacccaccccccaaaacagagcattcttgctctgttacctgatagaaatgtataactctattctcatttttttaaatttttattttttgagagagagtttcactctgttgcgaaggctggagctgccttctgggctcaagcgattctcatacctcagtctccctagtagctgggattacaggcttgtgccaccatgcccaggtaatttttgcatttttagtagagacgggatttcaccatgttgcttaggctggtctcgaactcctggcctcaagtgatctgcctacctcagcctcccaaagtgctgggattacaggcatgagccaccacacccggcccacaactctattctcttttcattttcaggggaaattagtaactttaataaataaaaaaaaattatgatatttataaaaaatactttgaaatatacttttatgaaaaacaatttatgaaaattactttgaaaaataccttgttcaagataatctgcctaaacctgatggagtataagaaatttagcaatatgatatattcctgatattgtagttggagaaaagttgtcttctacctaaaaagttgtctgggttgaccaagtgttttttcagagtaggatcttaggttaaaattataccagttcaacaggaattgccctgcataaatgagaattgtgatcaacctctcttagatggaatgataagattaaaaagcaaagctacactaaccatccagatactcactcagatttgtaaatctaaaagcatcatattagttaaaaatgtatatacattaagaatgtttgagtttatttagaatgacaaaataaaggaacatgaagaagattacaaacacaggtatcaaacagcatgaaataaacacaagaagttataaatataacaaaagctataagggctcaggagacaagtttattatcagctgggattacaaacaaactaataaattattttcttttcatgggcataaaaatcactgaataaattatctgaattagtaacttatttagcaataaacgtttctagaattcaatcccaaacctttgttctctatattatgcaataaggagctgaaatttcaacagcaaactttaattttcagactgtttaagttacttttctaaaaaagttattttaacataatcatagtgatcttaggagttttacattttatgagagaaaagtataattggtgtttgaaaaaaaaggttgcttgatttcttatgatttactcttttacagaagacaataagaactttgcacaatatttacatcatttctgtaaatgtaacagcaacagtaagataccatacccagggctgagtttatttcttttaaaggtgggagcacccatggagctttgctgattttcctaaaattagtagcaagggccagatttgtacctggcactattctaatagaacagcctctgttcaaatgagaagagcaagggaagtcccagaattccacttaatggtaaccaaatttcgaatacaactttacatttaaagcattggttaagtcctgattaagtcggcctctgatcctgtgctacgtgccttctattgactgtgaaggcaatcatgaatcatgattacccttttgaatcaggtataccctaaaagtgctgtttcatatatattatcacctcatctaactgtaggcccctaatcatttaacacatagaagtgtaaatatatacatggaaaataacaagaaatactagagtgacttacatggtaaaaacatccagtgtgtctccagcagttcttgccatctcaaagtaggtttgcagaatgttgacagttccagaaagcgcttcatgaccgcagccacagaacagggcaacacccgcatagagcaggatggtggcaatcagagaggcatagggaatgccccccaggcatttgatacagcattcaaaacaccctgtagaagatcacaaagggagaaattcatatttttgttaacctaatttaattttttttttcaaacttcagcactatgggaaagtatatttgcactgacaataccaggtcaaccatacaaatgaagtcctagagtgcattgaaggatactaagatcaaattccttaattataaacccatcctccacaaataagagaatgtttgccatgactgatgtcttcctcatctaccgcaaaacctagagaagcccttccttcccaacccagactttctataataattaatcttcaccatacatgcatgcatatcattccatcttgaatttattgctcccaaatgtcacatgcttatggttttatttcaatggtatttattcttttgcactctgtgtatctgcatttttctttttttgtaacagatatttttattgatgtgtcatagttatacaagttttggggatccaggagatatttggatacatgtttataatgtatgaggataaaatcggggtaattgggatatccaccgcctaaaatatttatgttttctttgtgtcggaacattaagattcttctcttctagctattttgaaatatacaatagactatttttaactataatttccctactatgctatcgaatactagaacttattctttttacgtaagtgtgtttttgtacccattaaccaatttttcagacagtaagttgaagcctgttagtatgttgtgaagttaacctagtgaactgttttctttcctttattgagacagagtctggctctgttgcccaggttggagtgcagcggaacaatctcggctcactgcaatctctgcctcccgagttcaagagattctcctgccttagcctcccaagtagctagagctacaggcacacacctccgtgccccattaatttttttgtatttttagtagagacagggtttcaccatattggtcaggctggtctcgaactcttgacctcaaaactcagtgaactttgaccagcaaatattaaaagtgacagagactggaagagacaatatctgaattcatgttatgtagtaagggaaattatttttgactcttttgacttcagtactcctatatgatatttgagtggtgactcataatgaaaatctacttcttgctatcattcatggtttgaaaaaatgagaaagacactggcacagcaaatgagagcacattggacacaccaatccctgtgtggtttttgccaaatttattcttttgagcttattgtctttaaaaatgtgacaataagataatctctcatatggttctcatgagcattaaatgagttaatataaaaaaatagtgcttgacatagagtaactactcactacatgttatctgtcattattagatgtaacctaactattattacttttgggggtgggtggaagatggagtctcactctgtcacccaggctggactacagtagtgcgatctcggctcactgcaacctctgcctcctgggtttaagtgattctcctgcctcagcctcccgagtagctgggactactggcgcacgtcaccacacctggctattttttgtatttttagtagagacggggttttgccatgttggccaggctgatctcaaaccttgacctcaagtgatccatccaccctagcctcccaaagtgctgggattataagcatgagccaccacgcccagcctaatttaactattattcatatgaactattactgtgctgtcatgtggttgtcaaaaattctttggccatcatggtcacttttggtttttgaagtctcatcacttttacttattaaaacacagctttaagcatttaaactgagacatcagaaaatgatggtaaatattcaaaataaaggtcacaatttcctaggctattgctagatatcttctaagaaattaactagaaatgcttaagtatatatgttttgcaagagcaaatactggtgaggcactatgtgccagccacagctgataaaggagaatttagatgagagagctgacaggctaagggtacttgcaaggatgacctaggttccatatgtacccacctctagccaccccacccctcagatacacacacatatcctcattccaaagatttcctccttatgaaaatccttgatcaaatctgtctttgtaatgctgaagcccctcagataatgacttttcctttttcttcagaaacaaatgacaaacaagattttaaaatggattattattgtgcttaagtcataggaagatctgtgtgcactttatctagaaggcatagatgcatatagcaacatatgaagcatgtgataattgcaaagttcctgtgagaactaagtttatattgagagattgagctagtctgctatttttaatgctgctcactgaactggccttcttgacaattctagtccatcccatctgccccagaggaggttaaaaaaaggagtctgaacaccttcccacttcagtagctgttgtttgtgcaggcaaaattgtttcttgaacattcctcccccaacacacatctctctctttctctcacacacacacacacacgtgcacgtgtgcacgcccccccaccccacacacacacaatgtggggaagtagaaaaggttagaacagcttgaaatttcatgtaataggaagagatttcaccagcagatggctaaaaacaatgtgtgtagtgtctgaatgtcactgaacacagttttgggtggagattaacagggcagcagaaaaatctttcaactattctgtctcttgatgttctacaatttccacctcactgattatttaaaaataataatcataaaaaaattagtgccagcccaatgtagagctatccctatttttggcaagtataccacatagcctcatgattttaaatcctattcatctgtgatttctgtctttcactgttctcgaaggatttgatgtggttgtgggagatttctactgcagacaatcagaagtatgaaaaccagatagatgaacatgtttcacaaaactgttcaaggtagaataagttcatatatgaagagttcaaacactgaatgcataggtgggaattgcctttgctggatcctagagcctaaagttaataactgagcaaagacaaaatcagaatcaggatagctcaggagcagataaagtggtaagctcatgactgatcaccaaaaccacttctggggacttctgattaatttaagtattaattcagggtcggtttcacttatttctcattttctccactctactttaaatggaccagttctagcctccacactatgctctacagctgcaagggggatactggagttctgcatcagagcatcaagtataaattcaactgagtagtggctttcaaatttagaaagaaaagcccgagataaattccaaaattgggtcaacccaaattgacaactctgagataacgtgcatttccaaatgagtgtaaggtctttttactctatgtaaacagtattatttaaatctctcagaatcatattacctttatggcaaatacaaattcctctaaacttgcactactgtgaagttaagctaaaatcttttgacttaagacctgatcatccgtcaaacttctattcaaaggaagaaaccttaagtatttcatcacacacatttcgcacttgtaacgggctagatcctaactatccccactcttccacagagcccgagttgcctattcgttttaaaagaagactctcagaactcccatctggggaagcagcgcattatttcagtattctctccagctgccaggatcccacgtagttgctggcaggggagcttctttccacccacagagaggaacagccttggcagagcagcagagttgtcatagcaaccctgcccctgggccccggataggttcccaacaatcaccctttaaggctgcggatcttgctgcccccagtaccacgttttcactgaactgcaaatgaaaagccactgtattaaatgaatattagtgaaggcataggaagtggagtgctggtgctggagaagatatttttttcttgagaaactctccagtaaaatgataaagattactttgaacaggaaacattttcaatactagatattataataaaaataggcccattaattctcaaatagaacagatggctcaaatagggaatactgaatttacatgttctagtcactacctatatacacaaagaggtatttctcacatccattttctggttatactttccaaaatgaaataatactgtgccttcagctttaacatgaaaacaaatattaaaagaattatgagatgttcaacacaccctctgaaacattagcatttgcccaaagattagtgaagttatagattgacttgtactaatacaagaaataacttcaaaatttcaaagaaaatagaagaaatagaaaaagaaaatagaagaaatagaaaaagaaaatagaagctgtgaagatatgttatctttaaaaaaagatactgacatttttaaaaagacattgattaatttatttccatttaaacattgtgaagtcaaatacatgcctttgcttttgctcactccacaaactgcatcaaaacaaataaagggaaaagaacctaaaccaataagaaaaagaccaggagagacagacaacaaagaagagaggccaacaaaattgtggattctggaaaagtgattgacaggagaggttgagaagtgagatttacaatagactgacaattgactcattgataaatttttcctaatattatttaccaggcggctgattgctcttctcctgacctacgtcatttttgtcattatcaagtgtccagagaggtataggtctgtttgagggctgtctattctgtcccattagtctgtctatcactgtgtcagaggtgtttaaaccaaagcaactccatcttgaataggggctgggtgaaataaggctgagacctgctgggctgcatatgcagtgggttaggtattctaagtcacaggatgagagagtaggtcagcataagatacaggtcatgaagaccttgctgataaaacagggtgtagtaaagaagccagctaaaacccaaaaaccaagattgcaactagagtgacctctggtcatcctcatgggtcattatatgctaattataatgcattagcatgctataaggcactcccaccagtgctatgacagtttacaaatgccatggcaaagtcatgaggttaccctacatggtctaaaaaggggaggaaccatcagttccaaaaattgctcccccctttccccaaaaactcatgaattatccactccttgtttagcatataatcaagaagtaacagtaagaatccttggtaaagcagctcaagctgctgctctgtctatggaatagccattctttatccctttactttcttaataaacttcctttcaccttgctctatgggcttgccctgaacttcttcttgctcaagttccaagaaccctctcttggggtctggatggggacccctttccagtaacagttgggccaataccacactgccttatagtatgttttgatttgtggaggaaattgcctcagccaatgcattttcttcatgaatgtcatggctattcattgcccttctactttaccaatcaattttaaaaacagtttgtctgattacacaaattaactcattgggattctgattggtctttttgcatttgtataaattatttatgtaatttagatattaattttttatccacaaactttaaaattctttcattgattctgtgaattattttgagtttgtggattattttaaatttaagttgataatcataccacctgtgaaaattttgggctttatttctttttttttcaatatatgtgccttttactttatcttcttattgtcttacgctattggataaaatacagagaggaaattaaaagtaatgcgaaaaggtatcttttgtgatcctgatattatcgatacttatgcttttacctgatacttatgcttttaccattaagtttgatgcttgcggttgttttattggttaaagatggtctcttgttttaaattctatcatatgcttcccatctggtaaaataattttttttcttctttttatctaccatttcaataaatttttctaatgtaagtgaaacttgcattcatgagaaaaaaaatggtgtcactgggtttttaaaaatacatcactaaatttgtcatgctaactttgttcaatacttttgcatttatcaatgtatccaacagttattgagcccttgccaggtgtcagacactatgctaattgctgagaccttagaagtaaacaaaatcaatgaaaatctctgctttcattgtagaggtgcaagcaagattataaacaagatactgaagaaatataggtgagattgtgaaaagttcaaggaaggaaatctaaacaaagaggtggggtaaggagtactggaatatcagtttcaatttctgataaagagaccagggaaggaataactgtgatgacatttgtgaaatggtctggaggaggtaaagggatcatccaagaggctatctgggagaaggtttattttatttatttatttatttatttatttatttatttatttgagatggagtttcgctcttgttgcccaggctggagtgcaatgacgcaatcttggctcactgcaacctccgcctcctgggttcaagcgattctcctgcctcagcctccctagtagctggtattacagctgcccgccaccacacccagctaaatttttgtacttttagtagagatggggtttcactatgctgtcctggctggtctcgaactcctgggagaaggtttcaaacagagggaaactaaatgtcaatgccttgaggcaggtatgtgtctagagtatctaaggaaaatttaagagaccagtggtgccaaaatagattgagatagagacaaaggaacacaggagaggttaaaatataataggtgaaggtatagggacatcaatatgttaatgaatgtctttgacaacaaatttttgctttcttgttttctagtgaagtttataccagccttgtaaagtgatcccctttttcaatgccctgggagagtctgcataaagttgtaattacctgcacagtaaatatttggtagaacaaccagtaaaactatccagtccacttgtgtactttatgggaagaatttaaactactgatctaatacgctgatgtttatagagtgattcaagtattctatttcttcttaaatctgtttgctaaattcaatttctgtaagcatacgtaaacttaataaaatatattcattttctcattaagttgtatataacattttaaataatatttttaatgcgttcgtcatctgaacgtatttcctttggtcttctccagtgattttaattcttccttttttatttcattccttctttccttcctccctcttctcctcctctctcctccttttttctttcccttttcctccctctgccccctttctctctctgtctctctctctctctctacgtgggcctctctctctctctttccctctctctctctgtctgtctttcttttcttcctttctctcttcttaaagagcattggccaggacaacctatgttttacactctttgtttgctattaaaataaacaggctggtcacggtggctcaagcctgtaatcccagaactttaggaggccgacgtgagtggatcatgaggtcaggcgttccagaccagcctggccaacatggtgaaaccccatctctgctaaaaatacaaaaattagccgagcgtggtggcgctcacttgtaatcccagctactcaggaggctgaggcaggagaatcgcttgaacccgggaggtggaagtttcagtgagccgagatcatgccattgcactccagcctgggtgacagagcaagactccatctcaaaaaaaaaaaaaaaaaaaaattcaatgacttaaaacatcacattttatttttcaataagtctagaatatttccttcccagcttcatagtggggatctcttcccattatagccattcagaagctcaggttgataaaggaaaaccatcttgaacactgctagtcatgatatcagaataaaaaacaccagggaaatctcactttggcaatctagtattctagactctaggtagtacatgccatttctacaccagcctaatgggtagaaagagtcacttgcctccccttcaaacacaaagaccaaaaagtgcaactctgctatgtttccagaagacagggagccacaaaacttagcaaacagcactaatgactatcataataagtaaagctgaaggttttccaacattattattcttttcaaataagctttttttggtatgattattttgtttcattaatttctatttttagattaatttttttctttatttttattttctttgggtaaattttcctatatatgttctaatgttttaatgtggaaagatggatgctgagctcattgctctttggacttttctctaataaaagtatttaaccctataaagttaccttctaattctgatttgagtgaattccacaagttctgatatgcaaacttttcattcttgttcagttttaagtattctctaaagtttattgagatctctttttgacatataagtcgtttttttcttggattatttattttcgttttcaaatatgaaagctttttaaatcttctgtatgttatctgtttgtatatttattgcattattgttagggaatatggtctataggatgccaatcctctgaaatttatagtgacttcctttaaattaaatccaagacttgagtttttcggtttctgaaagtagcagaaattttcatcaccaactcacaggagagctggcttgtggtaccaaattctcaggagacatattttccccctcaactcactcaaggtataaaagatgtaaattttcctttctgccttacacacaacttttgttactattattgttctgtaattttttgctttgtttaattttgttttcctgtctcagcctttcacagagtcctttagagtcctgacccttatgctgtgtgttccaacttgacctccagtctcaggctgaactcagctctgtttcctaacctgtattaccaggacacccaatgtgaagcccaaggagaccaggaatatgaaaacgacccaggccctgctgctgtctgcagtgctttcttgcttagctccctgaacttctcctttaactttattgttggcttctgagggttctgcatactctcttgacagtacatcaatgtgtacatacatgtgtacatatataagtaattatattttaattgtacctatattttaaatgagcatattttaaatacacaagcatatttgtttcaaaacttcaattgtttgggaacaaaaaaggttttcttgctatttaatctaccatactactggtaattcactcttaattagaaagagacaaccactaggtatttgaggaatgcctccaacttggaagacagaaacagaaataaataagcaaaaaagaaattccaagaaataaaagataaagcaggcagctgaagagagtttaaaaagggcacactggcacaccaaatatatatatatatatatatatatatatatatatatatatatatatatacacacacatacatacatgtatatataaatataatatatttatatacttgtatatataaatacatatatgtatgtatatatttatatatttatttagaatattacaaaatatattgcattctaaacaaaatggatgtatttctttttacctaaaataggaatttgagacagccaagttaaaagggctccccagagaatccccagctgtcttgtgcattcggaggatggagttgggcctggagaagttctcgctagtttgggtggggggtggggaggctggcctcttctgtccctgtgtagtaatctgggattcagttggtgaagtagagagcctgttagcaggactccatctcactttgctgagttgtatttcctttttccttttcgctcaatgaattccactcatcacccttatatgtgtctgcaagcctaatctttcctggtcatgtgacaagaacagttttttcctacaataaatagatgctctaaataggcaactgcaataaaattaaaagctattattaaatggaaatatagcagaagtttacattttcacagtttaaagacacacacacacacaaagaaatctatgacaaagtagaacaaaaagatggaaattggagagaaaagataaacaacttagaagatcagacaaggaagaacaaccaccacaattgaatataatgagattcatcaataaagcagtgaaaatgaagattagcaaattaccaaataattaatataaaacggtttcctagagttaagggcatgagtctgtagattggtagcactcactgagtttgcttctggggctgaattcctcccttcctgtagctcttacagcccccactacctcctgctgccctgcggccacactatggcagagccaggaggcctgatgctggctcgtggtgcccccagagtgctccaaattaataaagaagagctagagcaattggggtcatggacaataagtgtcttagaaaaagtcatcatcagagaaggggaacaagaagtgctttcaactaaatttaaagcaaatgcttttatttagaggactatttctgaaaacttgtaacaattcgaagttagctttaagacctttttgtgtctatggaaatattagtggagtgaggccaacctgactttctcttatcctaacactgagggaaacatgtcccttgggtagaaataagagaacaattaaatcaagacctgactgtaataagtttatttcacatgctcactccttttttctatgcctatgctagcagcatgggcacggaatcactacgttaatattcagagaatgtttcttgagcacctgtttcttctacacactgtgtatacagaagtgatcaaaaaatatggtctctactctgtttgagcctatataccagtgagaaataaaattagaaagttctggcaccttttagaaaaattcccaaaaacatcgtaagaaaacatccaatattgtgatatctttagtgtccagttggtgtagccaggattgcagtgctcatcagcacatcagaattagtgaccgtgggcttggagttcaaaattatccaaagaatagtagactaaaaagctccctggcataaagtctaacatgccataaagatgagtaaggatatttcaaaattgggcttctgaggaaggctttatactgtaaaatgtttagcaaacacactctttaatagttaaccctttaatgaatgacatgataatctctatttttatttttatttttatttttatttaagagggagtctcactctgtcgcccaggccggaatgcgatggcaggatcttggctcactgcaacctctgcctcccgatttcaagccattctcctgcctcagcctccagattagctgggactacaggtgcacatcacaacacctggctaatttagtagagacggggtttcatcatattggtcaggctggtcttgaactcctgaccttgtgatccgcctgtctcagcctcccaaagtgctgggattacaggtgtgagccacggagccctgcctgatagtccctatttttaaagccttttagaatatagctcaaataatccttaaatattgttaaatttttattaacatcttatttaaatatgtcctggcctaaaaagagcacaaagtcaaagtaaatatttgaatcattaagaacacagaggcattaccaaaaacaaactcaaatgacaggtgtttatcttaaacattgtagtcatggctataatactctgcttaaacaaatcagttactaattttaaaagaaacatctttaaacaggaaaaaattcgcagcgttcaaaggcatttttgtatcctctagtacaaaatggaggagcattttcactgcattttttgctgaatctcattatttttgatagcggttgttggttttccttgtctgatcttctaagttgcttatcttttctctccaatttccatcttttgtctgtttgttctactttgtcatagatttttttttgtcttttagtccttctgtgaaaatttaaacttctgctatcatatttgtatttaataatatcttttaatttttttggtagttacctatttgtggatgggtatcaaaatcaccaggggtgctgtcaaaaatagatttttagatgtcctctgttgagaatcttgtgggtttttatcaagttcttcagttcattctgatactacaagatatgcaagccacgcagtattctataaaatcacattagatgccctgaatcctttaaaagtatttgataaaccaggatatgcatgttaatacaaagataaggaattactctaagaaatttgaacgaatgattaaacaacatatacagtttataactatatcaacaagaatttttttaacagttccaaggcatcagaaacaatatcaagacttttttatttttttgtttttatttttatattttagaggcagggtttcagtctgtgcccaggctggagtgcagtggtgtgatcgtagctcactgcagccttgacctccaggactcaagggatactcctgcctcagcctcccaaagtgttgggattataggggagagccaccatacctggtcaccaagactttcaatgcattgcctggtgtggtctccacagctatcatatgaaagagctataattatagtcaggcaatttctcaagtggttattgacagtagatactgccagagtacatgaaagcctatttattatgaatttttcagaagaatggtgacatttttatgtttaaaatgctatcatgaaaatgtttattaagattaatatttaacattcagaccgtttttttttaagaaatatattactaattacagaacattctgtactggtcaacatgacttagcaaaactgttttgattaattaaacttgttccctaaggcagagaagttaattgcttctattatgagtagaaccatactcttctgactgtgatacataagcccctagggtaagggaacagtcaggtggagacacgtttctgatgtagaaaaacaatccctggaagaaaaaaaaaaaaaaaaaactagcttgaattccatacacctgtggggttttgatatcccataccctgcttgttcagataatgtctggaaatccagttaaaaccctcattttctctgtaataaatggactaattaacataaatgttcctcccctaaatgtccacatgatttgctctctcacaatcttcaaaactttgctcaaaatactcattcattcatttctttcatgtgtgtgtttgccatttattgctgcctcacaagccattcccaagatgtactagcttaaagcagcaatttattataatttcccacatcttcatgggtttattggtctcagctgggcagctttcactcgggattgttcacgcagatgcagccagaaagtgaataggtctgcggtcatctgaatgcttgactgggttggatgtccaggatggtttcttccttgcacgtacggcacctcagctagcatgcctcgaactgctgagaacttgcataattttgccacattttattatcaaagtaatcacaggcagctcagattcagctgggagaggggatgggaggaagagttgaagactaaatgggagtggggtagaatctgcagccatgtttagtctgacacaagctgatctattttaaaattgaaatttccacccaaatgactgctttctttttttccataacacttatcaccatgcaatgtactgtttatcttactattgactttttttttttttgaatctcttcactaaactatgaaagctacgaggtcaagaatttgtattttctgtccgggcatggtggctcatactgtaatcccagcactttgggaggccaaggcgggcagataacctgaggtcaggagtttgagaccagcctgaccaacatggagaaaccccatctctactaaatatacaaaattagctgggtgtggtggcacatgcctgtaatcacagctacgtgggaggctgaggcaggagaatagcttgaacctgggaggaggaggttgcagtgagctgagatcacaccactgcactccagactgggcaataagagcaaaactccattaaaacaaaaaagaatttgtattttgttcatttctgtatgcccatgccctagcacaatatctgacacgtagtaggtgctcagttaatatttgttgaataaataatccagttgaaaaatatgtctcaacaaccaactaagacagatccaaaagtggtcattagcttcaaaccctccaccatgtccagcttgcagagaaatatcagaatcatgataattttctactttgggattaagaatgagaaatatgggcaatgaatggttagctaccacacaattttgtgttttcctcctataactcttttaaaaagtgagcctatttttctttctgagtaactggtaaagagtgtttatgtaggtttgctggagaggtaattcaaaagtcttcctgtattatactataatcttaaatttgtagaagaagaaacttgttgtgcacatcatacaatagaatgcaacaaagtaactggcaaacttggacttgtattgaatgtattcatctctaaacttctgttttgttaatgacacaatgttgaagattatcagtatgactctccaccaaactcaaaataaaaacacaaacacacaaaacaacaacagagaaagagttacagaagaccctgagaccttcagaactattaaattccaaacagggcaagctgaagacattgccaataaatgtaaaaataatcagcctgttaagcaaactaattcaggaaaagaagatagtgtttttcttaaaggaatttatgatcacaagttatttactagtatttaataaaattttccatgattttgaaaataatttgttaagtattgctccaaaataatgcaattcctgggatatgtgtctcatggaaacagatttgtctatattttatcttatctcacacaacatcaattcagcaactgaaggaattatttcaaagtatgacctggagtatgtcagcctcctgcttaagatctttcctcaactttcctttacattaacttaccattatactttccacacactccttctactctaggatgctgtgtgtgatctcgccagcatcatttcccactgcggcccacttggctcactgcacaccagctacattggccacctttcaattcgttgcaaaccagcctttacgctcttcctgtttcctctgccttgatgatctgatgctcttcccatgctaggctccttcctgcttacagcttaaatatctcttccttagagagaatccctttactgtccatgaaagagaacactacttattttcaatatttaacaatgactagtgaaaatctggtattcattggtggtcatgtagaattctcttgatcataatatccattcaattccataatttaatcatagaagcttattttttaattatgcatttttctgcctaatctcatcactcacagtgacgagacttcacagattgccaaaatttttgctgcagttggaattttataacattgtatggtagcactggtataaaatgctatttccacatatagacatagacatgagtaataaaagataaacagtcattacttaagattgattcttcttagatagacaactttttaaagacaattaaagaagagaggaccagttgataagattggtcctctaggaaaaagttggaatatgctgcattagacaaaaatatctcaaacttatgagaattacacaatttagtcttcatgttttgttcttggttaatatgataaagaatgtattataatttttctaatgtcttgtggatatcatggaaaagctgttataattgccaagagttttcagcataaataaggcattttctgttgctaaataagtattatgtgttatttagtgaagcaacatggcatatgaagtcactttttaactttaaacagtatataaaattttgtaaaattgcaccaattcagtatagcataaatgtgccctcacgaccacagcaattttaagatgctttcattattatggttattgagaaattttcttaaaacaaaaataacagctgcaaaaatggcaatagcttatgttacgccagatattctgtagatttgtttttataaaattagtgtttatatgtatctttgctttttataatgaaatgaattgatctggcttttaatgagaacagaatcccctacacaagaattaactaatcaaaaatattttcatttatattttactatattgttactttaaaaacaataaaagaacaagtaaaactttgtaaactaatctagaaaaagaaatatttacattagactgggtgtggtggctcacacctgtaatcccagcactttgggaggctgaggtgggaggatcagttgaggtcaggagttggaaacaagcctggccaacatggtgaaaccccatctctactaaaaatacaaaaaatagctgggtgtaatggtgggcacctgtagtctcagctacttgggaggctgaggtaggagaatcgcttgagcccgggagacggcggttgcagtgagccgagattgcgccactgcactccagcttgggtgacagactaagactctgtcgaaaaaaaaatataatgaaatatttacattactacaattaaattggtgaatgcttaaaccatatgacacacacacataaaccaggaatgtatgaaacaggtttgttcaaagcaccagtgtaaaaaggcaaagatgggatcatctaccagcacactccactacacgattaaatacaaatcattttaacagaattggagcatacttaaaatacagttgagacatttgaagccattcttaaaaataaaaatataactttaaaaccaagtgactaaagtaactataaaataaatactgattatgaattcaagttgtgaaagaaaaattagaaattaaaaaattcaaattctctttaaaaagagaacatgaattacttatagacagtttctttaatttagttcatagaaactcactaagacatttgcagatacaaccatcttactaaaaacataatgatagatttttaatgcaatctggctttttagaatttatatatttattccaaatttaaaaaaacattttttaagaagcacatatttttaaaattctatctcatagttactacaacataccgaaattgggtataacacaactttttttttttttttagaaggagtctcgctctgtcaccaggctggagtgcagtggcgcaatctcagttcactgcaacctctgcctcctgggttcaagtgattctcctgcctcagcctcccgagtagctgggactacaggtgtctgccaccatgcctggctaattttttgtatttttagtagagacggggtttcaccatgttggccaggatggtcttgatcccttgacctcatataacacaaaattttaagccatattctcaaatatttcctacatcaaaatgttatttcaaaatatgtatggactagagaacaaaacaaattctctcctgataatcacagtatgccgttttgtatcataaacattagcagaatgttcaaaatgggtatgtaacaattaatttgttacaatgtcagaaacaaattgccaccatttgttaaaaggaaaactcttctggagtcctgaagtgctgtctagagagcttgaattgtctaaggtacatttggaaatagagagacaaatggccgtacttcaaagtagatatgtcacttctgcaagcagtatcttttctcaggcatcagagactttaaaaagctaaaacgtattttttaaatcaaaagaataatattttccttctctctccctccctctctttcattaaagcagctactggcatatgctttgctccctaaggccagggaaatattagttcaaagtccctcataaatcttttcaaatgttatagaagaaacgtcgattttatttgaaccaagcataagcctgtcattttgttgcttctattacaatctgcctgagcaccctgataacaaaatacggatgcactgttttttcttacagcaaattcagtcttgaccaatttatcccattgcctaaatacttaatgtcctttgcttcttttgatcatatctcatatgacttttagacggtagaggctgaaaataaaggtttccagagaggttaaaaggactatgaacatatgataacagaatatgccttttagctgtttttgtattctgctcaccacaggacacatccttaagagggctcagcctacatatgaaaacctgcacttcacataaatctttttatttcatgttactaatccccagaattttatgaatacacacaaagctcattttcaattcctatcagtcacctctggtgactgtgaagtgaaaataagaatactgcaaaatagaagaatgtccatggaatatctgaaaaggcagaaatgctaaataaaacattagatctttattatttctagaatatgctttacactgaagtacagcactcctgtactgtgggccacatgagattaataactagttctcaagactaaggaatatgtttcatgtagctttatacgtcctgcatttcatacagagtttggctcatggacacagcactgaagaaccccaatgactgatcttctacttctattttctgatgtgtttttattcctttggttatcttttgtacaagaaggataagtcaagttcacccactaaaatgtctacccttcagtttcaacatgatgtccagtcaaattatattggaaaaatatatactgaattcacagcaagagaaccaaaagatggatcttgaactgaagaaaccttagaaatgtatttcacaatgtaaagaaagatagtcatttctgcatttggctgtaactggtcgctgctgaggtgtgatgaaaagactatagagaaagtaatatcagaactgtgctgtttctgtttcatgggtatttttccaacaactagtagttactttagcttttctagtatatatatatactagtacatatatattatatatatatatgtactagtatatatatattactttagcttttctagtatatatttctagtatatatatatattttctatttttaaaaagaatatatatatattctaatatatatatatatatattttctatttttaaaaaggcaagatctaggccaggcacagtggctcatgcctgtaatcccagcactctgggaggccaaagtgggcggatcatctgaggtcaggagatcgagaccagcctggtcaacatagtgaaaccccgtctttactaaaaatacaaaaattagccgagtgtggtggtgcatgcctgtagtcccagctattcgggaggctgaggcaggagaatcgcttgaacccaggaggcagaggttgcagtgagtcgagatcacaccactgcactccagtctgggtgacagagcgagactccgtctcaagaaaaaaaaaaaagcaagatctaatttaacaacttcattaagaggtggtaaggggcgaaggactggttttattatctgtacagctgctgtacaaacttaatagtttaatgttttcctcaaaccactggaaagccatgggagctaattcttaaagacacttcttactacataaataacattatttggaattaaaatatagaagacaataaatattctgtattctcgatgaaaaactgttgacacttcatgtggcttcaataggtagataataggtattcacaaggtatatacatttgatggtgagcaaatttagataattgaaaagattatttttacccaacatctgataatattcatattaagactgaacttggaattgaaagtaattggagtgaaagacattcacagtggttttaactaatgacagagaaaaatgtattccagtgatctgtagtaactttcactattttccttttgttctcaagtgtggccaagttacatgcaataatttataaaattatattatgcgccaggtgcaatgtcccatgcccataattctagaactttgagaggctgaggcaggagaattgcttgagtccaggagtttgagaccagcccgggcaacaaaataagaccccaattttacaaaaagtacaaaaattagcctggtgcgggggtgtgcacttgtagtcccagctacttaggaagttgaggcaggaggatcccttgagcccaggtatattttaaagactgcatgagctgtgatctcaccactgcactccagctgggtgatgagagagtggaagtcgtccagtgaccctcaaacagaccaccgaagagaaaaactccttatctgaggaatttagaagggaataaagaccccctggtcacatctggttccagcctctttcaacttttataagtaattaaagtttttatgcatctctggaatgccatgctgaaactcattttgcaatcttaagctcccgcagtaagatccataaatacccctaaggaaaatccaccacggatcgcggctgcacccttttgcagctttcttcctttctaataaactttcctttttcacacctatactggtgtccataatttacttttaccaacctgtgagtggacctttttccggtgtggggtctctgacacctcacccggcaggtaacagagtgagaccctgcctcaaaaaacattatgttgtgcatgatgtacaatatgtataattttctttttactattaaaaccagcaatatgtttaaaaattctttctttgaccagccgtcgtggctcatacctgtaatcccagccctttgggaggctaaggcgggcgaatcgcttgagcccaggagttcgaggcctgtctggccaacatggcaaaactgtctttacaaagaaattaaaaaaaaaaaatgagctgggcatggtggtacacacctgtaatcccagcagctcagaaagctcaagtgggaagattacttgagcctgggaggtggaggctgcagtgagccatgattgtgtcactgcactccagcctgggtgacagagaccccgtctaaagtattgagacaaaaggtttgtggtagctccaatggtttgctctcataatgagattctaaatatggcctacacttactaatttttagttacaaaagctatatatttttctaattttatttttctttcacttgacaagtcacaagacctggagtaatttgtaattatgactgaatgagcaaaatccagaacacaaatgtgacagaaacaagcttgaccatctcaggactaggaagcaaatgtccctgagggacttggattccatttatctttggtcccagaaaaaagttaaataaaagtgaacaccattgtgtgttagggttttctccctattttctcagcattatcctgactcccatttcaaccatttattttatttttatttttatttttttatttgatttttaaactccttagatgtagttgactaatcaagaggatgccagtttgaaaattcaacagatgctataatactaaaaggcaggcaaaagggtatttctgggggagtttggctagaatgctatattttcaccaaaaagttccagaaattgaactcataaacttactgtgtttcaattctttattacctaaattaagaaacaatatggaatggaatgttcatcttacagccttgttgcatttgaaaattaagagtaataagggaaggagctggtcttatcatttataaagacatattaagttatactaaatattgaatcttttaccagacaaataaaagataaactaatggaacattatcatcagttgatacattaaccccataactgttaggactctcatattttaaaaattttattaaaaatgtataatatattatacttgtcatttgttaatgttatttgttgtttattacaattaaaaatagacctaccatatgatccagcaatctcactactgggtatatactcaaaggaaaggaaatcagtatacctatgagattccttcagttccatgttcattatagcattattcacagcaaccaagatatgggattaatcatcaaaggatgaacagataaaaaggatatggtgtacatacacaatggaatagcattcagccttaaaaaagaaggaaattctgtcatttgcaacgacatggatgaacctcaaggccactatgttaagggaaataagccaggtgcagaaagacaaatatcatgtgatcttactcatatgtggaatgtaaaaaagttgaactcggccaggtgtggtggctcacgcctataatcccagcactttgggaggccaaggcgggcagatcacctgacgtcaggagttcaagaccagcctggccaacatggtgaaaccccgtctcgacaaaaacacaaaaattagccgggcatgatggtggatgcctgtaatcccagctactcgggaggctaaggtggggggaatcgcttgaacccagaaggcggaggttgcagtaagccgagactgtgccattgcactccagcctggaggacagagtgagattccatctcaaaaaaaaaattttttttaacttatagaatcagagagtagaatggcacttacagacgctgggggtgggcagaatagggagaagctggtagaaaaaatgaactgtgcattatatatgttatttgttaatgaataataaatatgcatggcaataaaactgagatagcttgagagtcagatgagaatagaatcaggccttgagagaagagtgcttttctctaaaacccgcagtagcttctcatttcctttggagtaaagacagaatccctacaacagattgccaagaccgtgcatgatgttgtccctcataactgctccgacctcaccttctacttcactctctctccctcactctgccatactctcctccttgctgtgtcactaacacccactacacactggcccttgggcattctccctggcgaggccctctactgcaaacattcttcccttacatatctcctgaactaacctcttcatttgccttcaagattttgctcaaattgtatcctgattactctacaaattgcatcttgctctactcaggtccataatgtaaactccggattctcatttacctgctcatacatagttgttgctcaattaatattttattttagtgataaaatacatgtatagtaattagaagaggatcttgcacataataagagctaaacaaatataagctcttattattaggcccaaaagaatagagctatattgtcttttaatgcattatgttttgggtttttgttttttttttttttgcaacagagtcttgctctgtcacccaggctggagtgcagtggcgccatcatggctcactgcagcctccacctcttgggctcaagtgatcttaccacttcagcctcccaagtagctgggagtagcaggcatgcaccaccacacctggctaaatttttaattttttgtagagatgaggtctcacaatattgcccagcctggtctagaactcctgcctcaagagatcctcccatctcagccacccaaagtgctgagattacagatgtgagccaccacacctaatcccattttcttatgccaaatgaggagtgttatattagtgtatatttttgtttcccatcacattttcattcaaacgtaaatgatcagcctgtatttccaaaacaataaaaacggtatcaatgagtacagtataaataaaaggtaaatctgtcttctgtctatcatataggatagtccaatgtcttgaatcaatatagaaaaaatttgtatgctattttgcattttaataatttacatgaaatgaatgctttgcagttcattggagtagatgcaaaccataaatcataattcaatttgacaacatgaaagataaaaataattaacttctatagcaagatacttcacagacatatcaaatttattttcatgtatcatacaatgttttccaaataccctgtttcttctttttttttttttttttttaagacggagtctcactgttgtccaggctggagtgcagtggcgcgatctcggctcactgcaagcttcgcctcccaggttcatgccattctcctgcctcagcctcccaagtagctgggactacaggtgcccaccaccacgaccagctaatttttttttttttgtatttttagtagagacggggtttcaccgtgttggccagaatggtctcgatctcctgacctcgtgatctgccctcctcggcctcccaaagtgctgggattacaggcgtgagccactgcgcccagcctaccttgtttctttactaatgcaactagagttcatttgaatcatttatttatctgaatctataaaaaattcttctgaaagtctcttagaaaaactcctaagaattgtgtttcctttaccaaaaactgttgtctccatattgtagaaaatacattctgaataaattctaatgaatatttttgtgtttatgtttttgacattatttcaaaagcacattatacatctaaatagctaatctttccttaatggaaactatgctgaagctttacattttataatcttcactctatgttggttatctatattccaggattgattagaattttgttcccattatgaaattccaaagcattattataattataatgcagagaagctaaaagacacaaaaactaaaatgcaaaaatgttactttaactttttataaaaggttcatatctttaatcccagcatgtggggaggccgaggcaggaggatcactagtggtcaggagtttgagacgagcccagccaacatggtgaaaccccgtctctactaaaaatacaaaaattagccgggtgtgttgatgtgcacctgtaattccagctattcaggaggctgaggcagtggaatcacttgaacccaggagatggagattacggtaagccaagatcatgccactgcactccagcctgggtgacagagtgagactctgtctcaatacataaataaataaaacttaaaattttctagaagagaaagatctcccatgaccttctaaattttaataccccaaaagaaaaaaatagtcaaattgaaaatggtcaaattgcagaaattctatactacatttcactgaaggaaaggaaaatagcactaattgacattatgtcatcggtattaccaaaagataacatgtttgaaatctttgaaacacactttcaaataattatttatttacaaaagtagaagcagtactaggcttcacaaaagcaacctagtagacttgaaaacaaagttctactacggcggttagttcactcatatcagaacgtgtacagtgtaaaagttgaagaatagcaaatactcatctaaagttgcaaatggaaaaaaatactaaatttaatggagaatgcaacatagggaaaaacaaattcatcttgtctgtattcattcaatatccttaacttttagtcacaaatctgttagtgagataagaaattggacaatttctggtctttttaattaaatacttaattttccagagtattgagtagatccatggggaaaatgctatactaatgtggtctgatttgccatggatttgtgtctcatagttaactgattagaaaactcatcacctaaatacactgcctgaatgttaccaattatccattcatttattccactaatgtaattatacaattataaaaacttacggcgtgggctgggcatggtggctcacacctgtaatcccagcactttgggaggcctaggtgggtggatcacctgaggtcaggagtttgcgaccagcctgaccaacatggtgaaaccccatctctactaaaaatacaaaaatcagttgggcatggtggcgcatgcctgtagtcccagatgcttgggaggctgaggcaggagaattgctggaacctgggagaccagtgttaccgtgagccaagattgtgccactgcacttcagcctgggtgacagagcgagactccgtttcaaaaaaaaaaaaaaaaaaaaacttaccggtttttctagaaaatatccttaacaatttcagatcatctcacttcttacatacttctggtaacaatggagcaactgtacactcatttgattagtattcatcatcataaggttataatattaaattataaggaggaacttagaaatattagagagaatgaaacataaatattttgaacacatgcaaatggtttgtagccattttcctgaaagaatcaaagagaaacaatgaagtcttttcccttaaaaacacaaactaaaaatgatccatcaccaaataaaatttaaaaattaaaaaaactaaattcaaaacaaaacaaaaagacttcatcgaacatatctttgtcagatgttattttgaaaagaacatagagcttctgaagccggagtacatgattttgttttccaacctttgtgtttattgtttttttgaccttgtatatttactttcccatcatgccagttccttttctgtagataaagatacaaataattatttcaaggactattagaatattcctagctgtggtgcagaggtctcagtactgctaagtaatcatgttttctcatataattgtttctattttttccatgctcataaaatttcctttcaacttcccacctatcccttgactctcagatcaccttcagttgcactgtaacttactctgaaacttaggctgaaagctgttggtgccctctccctgttgcatttcccctagcccttccctagttatctgacagtttcctttcaatctgtagcctttgcatttctttgtctgaaggtgtattcagcctcacaaatactttttctgctactgaggcaagtgcagggaaattaatgcccatctaagagcacccctcatccagtgactcacaggagctgagtataaatatctgagcttctctcttggggtgacagaactcttaaggtgtatgatctacactggctctaagtggttccccaggtggatgtggttccaactgctcaaagtgatacatggcttgtaatgtgtgctttactggtttccttatttccccaaattgtattagccatattaatttcctactcccctactgatgttttcctcatctatcagatctaataccaaaactcaaatctctgtaccagaacagtttctgggggaattcaacttaagatagtgaccacaagttccagtttgctaaaacaatcctagcttcattattaatagtgcctattttcattctccaaagtgttcccgtttcagtgacaaattacatggtcatcctactctagggattatagaaaccatcagattagaatgcccctctctccccggtggcaagtacacagatctgccaggaaatgcaccttgacccattcagagtctcctctatgttccaagtgaaaatcccttcactattgacaagtgggaagatctccctgtctatttaaagtcagtttctcatggatacaaaaaaatagttggaaaaaataaataagaactagtatttgctagcacaaaaggatgactacagtaaaaaataatttcattgttcatttaaaaataactaaaagagtataagtggattgtttggaacaaaaagtataaatacttgaggtgatggataccctacttacttgatgtgatggttatccattgcatgcctgcatcaaaatagctcatgtaaataaatgtatacactcactatgtatccaaacaaaattaaaaattaatatatagtatatattatctattatattatttataatatattatctattatattatattatatattaatatatgtatttaataattatttatgtatttaatgtatatatgtatttaatgtatttaataattatattatatattaatatatgtattcaaataatatatatattatttaatataaatttaaataataaatttatgtatatatatataaagtcaacttctctcctgatatctaaagatccttgtacagtcagtcatgctgcctttcatgcatacccaactttctcaactggattttcacattggcttccaactattattgaatctttttaaaaaattttacaaataaatataaaactctcctttactctgcatgcccttctggcagcttaagtataagctgctgtcctggtttatttctcttcgtagccaaactgcttctaattgctgcttgcatttttacatctttttgtcattttcttttatttatgtatttatttattttttgagacaaagtcctgctctctcgcccaggctggagtgcagtggcgagatctcagctccctgccacctctgcctcccgggttcaagcaattcgcctgcctcagcctcccgagtagctgggactacaggcatgtgtcaccacgcccagctaatttttgtatttttagtatagacggggtttcacgatgttggccaggatggtctcgatctcttctttttttttttctttttgagagggagtctcgctctgtcgcccaggctggagtgcagtggcgcgatctcggctcactgcaagctccgcctcccgggttcacgccattctcctgcctcagcctcctgagtaggtgggactacaggcgcccgccaccacgcgcggctaattttttttatatttttagtagagacggggtttcaccgtgttagccaggatggtctcgatctcctgacctcaagtgattcacccgcctcggcctcccaaagtgctgagattccaggtgtgagccaccgctgctggccgttctcgatctcttaccacacacaaaccattctcatggtttcccatgttcaccaaagtacatgattcagttctcatctaaactgcccactaatgacccctccatttttcttgacactgctttaacttgggtcaaaagatccatcagttttctggtctcttggcatctcttcctctactcctttgcctccatctttttccaccaacctcctggcagtctgtcggaccatccttttcttgtcgaccattcaaagggaacttagtgggtctgattgcatctccattggcccatttctatcagaagacgttgaatatcaatttgttatttctccaatttatgcttacttgctaattataaaaagataccacggcacatcttagattagttagaataaagacaaactctcagcttggatttcaaaactctttgttctgtggcccctgcttagctggagtttcatctctcactgcagccgatagactggaatccttgaggtcctccctgatgcacagccggtccgtgtactgcagcaccccagtgcctgcaatgcgctcccaaaccacacctccgccacaccttcattttcacttactgaacttctacacttctgcaacaattacttcctgagacaacttcccctgatcttcctgacaatgtcattccaccgagaatctgacctcaatcatgtctttgattctttaaggaatgtcgctctccacaagggtaaggcgcagcaggtttttgctcagtgtcctctacacagtgcccagcacaatatctggcacaggccaggctctataaatatttgtggcatgaacagttaaagcatctgaaaagcactctgtagaaaataaattgttcattattacaacttagttttattctctaggaagcagcctgaataacttttttaaaaagttagatgacgtcactccctttcttaaaacactttgatagcccctaagtatactcagggcgatagcctagtcctagcaatataaaggcttcacagtttcaacacttgctacctctctgaccttatctttgctgagctccagccccgctagccttgccgctcctcatgcatgacagggatgctcttgcctcaagatttttgcactggctgttccttgtacctgtaatgttcttccctcaggtagggaacacgacttcctctttcacttcctcacttcatttttttttttttttttcgtgacagagtgttgctctgtcgcccaggctggagtgcagtggctcaatctcagcttactgcaaactctgcctcctgggttcaagcgattcgcctgcctcagcctccctaatagctgggactacaagtgtgtgccaccatgcccagctaatttttgtatttttagtagagacaggatttcaccatgttggccaggatggtctcgatctcctgacctcgtgatccgcccgcctcggcctcccacagtgctgagattacaggtgtgagccattgcacccagcccacttcctcacttctttgttcaagcgttattgctacagtagcacacatttttctgaccttatccaaaaccctctggtgttccctattccttggtctctttttcttctatattaattattgccttctagtatgctagttaaattccagagctgtataacttttaaaagatgaaagacttttttctatgagtatgtgtgtatatggatgtatatatacatcatgtttgtcattaaatttatctatataatctgaaaaagcatgggattttggaagactaatatttgtttctgtaagtggtacaattatattaaaccaggtaacaaagatttcatcttatgtctttaaaaacgtacaaataatgagaattctttgagatgaaaatatcacctttctataactaactcaaatacttaataccataacttaaggctaccttgtagtatgtgatactagaaaagcttattgtagcttcttatgatacttcttcatacattgaaggttatcatcaaattttcatttacctcagagaaatattatgatataatgctaagatttacatttatatggggtttaaattttgaggagatttaacacctattaagccaattattaggcaagaatttctgtgttattaactgtatttcataatctgaggaaactgagacatagaatattaatttatttgcctaagtccacacaaattgcagcagcagagttaagctataagccacaaccaccgagtgtgggacccaagttagggacagacaatataataacgagtgaaatggacatgttactttcctcatgaagtttttagcccagtagtgaaatgtctttttactgtacaaaatcactgttttttttaaagacagtccttgtgaagatgcaagacaaataaataaataaactctgagaaataagcctaagcagttcaaactatggttaaaaaataaacttggcagtgtgcagtggctcacgcctgtaatcccagcacttcgggaggctgaggcaggcggatcatgaggtcaagagatggagaccatcctggctaacacagtgaaatcctgtcactactaaaaatacaaaaagattatccaggcatggtggcaccgcctatagtccaagctactcgggaggctgaggcaggagaatcacttgaacctgggagacggaagttgcagtgagccaagattgcgccactgcactacagcctaggtgacagagcaagacgctgtctcaaaataaataaatgaataaacaagcaaactaaactcaattgccctttgttgttgctgttattttacctatgtgaggagaaatgtctccttattggaggtttgactaacttcataacattcttccacttaaaaaaaaaagtgtttttttccaagtcaacatgtgctctttattttatgtacctgagatctaactcattcattctatctctgagagactatgaaaagaataaaacacaaagatagaggaaaacaatcctgttttcaagcttgattgtgtgcctgcgagtagtgggcccacagcataggcgcttagccatgctttaaaagctagcattaatcatctctaaaatggtcttttaacgataatttaacaattagtttatttagaaaattaaaatgccattatgaattatcatcatatttctggcattcctatttaaacttttgtcccaaacatggtaactcctacagagcatgcccaatttaatgctttgttctactcaaaactgaactttcatctctttcaatttgacttccacgatcaaagcttgaaaaataaaagtgcattttaattaaatctatctctcttactgcctatattcaatctgaaaccaggttgttttaatttttgccatatatatatatatatatatatatattttttaatttcaacatctgattgccagtgctgctcttcttacttgcaactcttcaatttgtacttttattaaaggttcagaaccaggttctgttcccttgtctttagctgttctcttttctaatttgcacccaaaagaccctcaattaaattggctcactactgtcacttgatcatttccctgtaaaaaacactcagtggatctctgtgcaataattattaagacatactgacattttctgaagagttctgcgtgattggccacaatgagtagtgaacaaagtagctttattttgatgttgggtggctgacatggtttgaacgtttggtctcagtcttctttgctagtttcaaggtttctcagtttatgttaatttatttcaaatgtaatcagtcctttactttttaaaaaaaaaaaatgctatataataggctgggtgtggtggctcatgcctgtaatcacagcactttgggaggctgaggtgggcagatcatgaggtcaggagattaagaccatcctggctaacactgtgaaaccctgtctctactaaaaatacaaaaagttagctgggtgtggtggcagatgcctgtaatcccagctactcgggaggctgaggcaagagaatcgcttgaacctgggaagtgaaggttgcagtgagccgagattgagccattgcactccagcctgggcgacaagaaaaaaaaatgctataatatttactttaccaaccttattccttatttgagcccttttatacccttgagaatgacttatttataagaaccctccacactacaagtgttttccaataagacaatgaacaattattgaatgcttactttataaatgtcatgaaaccatatttgtctttgttcagaacagtgctttatattgtatattttatatgtggcatttggtgcaacttataatagttttcaaagtacatccttcttgagttttccttacttaggcctaaattagatctgtgaaatacagagttaatacttttttcttccggcaaaaaatctctctcaagctctaacaggctgaagaattagtgtggaaattttataggaaagctagaaacaaatggccctagattttaggagtttaaaatcctggcgtcatataaagagaaaactgattatagttatattaagatttgatcctaaattctgcctaatttgggaagcaagaaggaattgctattcctaattattgttattaagtggtccattcttagtctctgagaaggacaaatacactaatcaggctgtgaaatgtaatgaatgcatagatgatatcactgtaaaatttttttcacaaacaaaatcattaatcaaaagtagaatacaaattatgagcctctattgcaaacaaccattagaactatttatgaatcttttttttttttttgaggcagagtcttgctctgtcacccaggctggagtgcagtggtgtgatctcagctcattgcaacctccgactccagggttcaagtgattctccggcctcagcctcctgagtagctgggattacaggcgtgtgccaccacgcccagctaatttttttgtatttttagtggagactgggtttcaccacgttggtcaggctggtctcaaactcctgacctcatgatctgccctccttggcctcccaaagtgctgggattacaggtgtgaaccactgccccctgtctatttatgaatcttaaaacacaaatagatttggaagataaatgtcatatgtctagagttatttagaaatagacctacataaaaatataaaggcagtcacaaacctttctaaattcggtttcatccacaaggtctgtgagactaaaacaatgttttcttttatttttatttatttacattttttagaaacaggatctcactctattgcccaggctggaatgcagtggtgcaatcatagcttactgcagtcttgaacttctgggctcaagggatcctccaacctcagccttccaattagtcacaggcatgcaccaccatgcctaattttttctttatgtgtagagatggcatcttgctatgttgctcaggctggtctgcaactcctggcctcgagcaattctcctacctcatccttccaaagcactgggattatagcgcgacccacagcacatggcataaaaaaaagttttcttgtagaaaggattcttagaaggaggcatgtataaaaatgtgaataaactaacatagagtcttcacctccgaggatctatgccacctgttttaaagaatgaccacctcattaccaagttattttatctttgtgcacaaaatattaacgatatcaaggttttctttaaaaaaatttgaaaataattgcaattctctataaagaagataatcatttttgttctcaataatattggctttacgttgctgaaacagaaataaataatatctcaaaatagctaaatttactgagtaaaaacttctagtgaaatatagccttcagatttattttaacaaggatgcttactggcatatttgtataaaatctctctttaaaagatagttattaattagtagtaataaaataaaaacaaatcttaatataaatgcaaattatattgcattgatgcagagcgtcaccatgttttggtcaccaagagacagcatatatgactgtggatcggtaagattataatgtagctgaaaaatttctatcacgtaatgacatcataggcattataatgtcatagcacaatgcattagtcacatatctttggtgatgctggtgtaaacaagcctattggaccactagtagtgtaaaagtatattacaaacaattatgtacagtgcataacacttggcaatgataataaatgactatgttactggtttatgtattgactatattcctgacttttaaagaactctagattagtcatgtcaatagtagaattcacttgggcacccaccatttacagaacacggtgtgaagtaaaagatgatctctgcttttgaacactcaaaacccaaagcacttcttggtcactgtattagtccatttagcattgctataaaggaattcctgagactgggcaatctataaagaaaagaggtttatgtggctcatgattctgcaggtcgtacaatcctgtacgcctgtaatcctgcacgcctataatcctgcacgcccgtaatcctgcacgcctgtaatcctgtacgcctgtaatcctgcatgcctgtaatcccagctactcaggaggctgaggcaggagaatcgcttgaacctgggaagtgaaggttccagtgagccgagattgtgccattgcactccagtctgggtgacaagaaaaaaaaatgctgtaatatttactttagataatttattccttattctgagctcttttatgcctttgagaattacttatttataagaactttccacattacatgtgttttccaataagacaatgaacaataattgaatacttactttgtaaatgtcatgaaaacatgttcatctttgttcagaacaaagcatggtacaagcatggtaccagaatcttcttcaagtgaggccttaggaatatctgagtcatgatgaagggcgaaggggagcagatgtatcataaggtaagagaaggaacaagagaggtaccaggttctttttaaacaaccaactcttgtatgaactaatagagcaagaattcaccaattacttggagagggcaccaagccattcatggggatgcacttccatgagatgagggcatctaaacatctcccactaggtcccttttttttttttttttgaagtggagtttcgttcttgttgcccaggctggagtgcaatggtgcaatctcagctcactgcaacctccacctcctggattcaagcgattctcctgcctcagcctcccgaatagctgggaccacaggcatgtgccaacacgcctggctaaattttgtatttttagtagaggtggggtttcaccctgttggccaggctggtctcgaactcctgccctcaggtgatttgcctgcctcggcctcccaatgtgctgggattacagacatgagttaccgcgtctggctggtcccacttctaacactggggattacttttcaacatgaaatttggagggaccaaacgttcaaaccatgtcagccacccaacatcaaaataaagctactttgttcactgctcattgtggccaatcacgcagaactcttcagaaaatgtcagtatgccttatggtcagtactaccattttgcttctcttggtggcactaatttgagaaaatattcttaatatgttttcttaaaaccatcccaagcaagctaaatacaaacactaaattggcaagcaaaggactcaactcatccatatacttcatagtatctctgggtgagttaggtagggagaccgagaagagggcagaatggggtcaaaatgaatgggaaaaatagagggctcagaagtgaaatgttcagtgatttaaggatgaaaaaaaatttttatagaaatttgaaaaatctctaagctttgataaacaaaaggcaaagataatttttaaaaatataattctcaatttctaaaggaacaatgtgttcatactgtaaacaatttaatgtgcagataatttgattaagtccaacaaattccatgagttttcattttagctgcatgctgagctccaccctccctacacaccatctgctatttgcttgagatatacaaagttataggtggcgtggatatcaggcagaattttaaaacctcagtttttaaaactcacagcttagttttgaaggctagtagtctttgctttcatgaaaaaaacatttaagtacaaaactgacataatttgtggaggtggtcatatcatgttctaagaaactagcaagcatttggtataagtctaaagcaagcattaaagaaaactacagctgtgcctgacaaggtgttgaatagaagatactttattttagttttcatctgacagagtaagttcctaattgttctcattaagttctttgcctgaattttaaaaattggtatgtttgttattctatttaccccattcttctcccaaaatctcatgttaggtcatttagtcatctggcatgtgtatttttgccgaagaaatataaattcaatcgtcaataataataaatttgatgcattttgtcaaatacctatagatggaagttgtttctaacaggtttcagacatgagatctgccatattttccaccaaaaacagaagtctctattgctagaaacaaatgttctttctaagcctacagatgactaatgcctgtagcttaatactggtaattcccaatttgagagctaataatgatcaaaaattaagtgttgttgaaagttactaactatatgcattagggaaattacctacatataaaatgcaaagattggtagaatggctaagctgttttgtaaacatagagacttttttaattccattcatgagtcacatttttataactaaattattctataatagcaaacctcaaattcttaaggttcaggggcaaaagtgacgttttgaaaatattttggtgaaccattagaatcctgagtcacttggcttctcttaatgtgctgagccaccataatctcttaagattttcttctgaaaaatgctaattcagctttatctattaagaagttaacgtttagaaattactaaattatttatgccttactttcacaaaaaataagagttttgtcaatgatcattttattccacaaaagtgaaaattacataaaaatattctggaaaatagaaaatacaaaaaaccttcaaaaatgactttaaaaaagtaaatagtatttgaccaatactttgctaagacaagcgtgtagaaaatattgtctctaagactattttttaaagctagcttagttaaatgttaaggaattatgaagaaacatatactaaatttaggctagcatattaaatatatttgtctcacttgatttaattacgtactcaaaaatcacaagcactgaaatcatattctatctgaaaatatatgtagtccaatatagaaattgtattaaaattactagctatatgataaaaatgaaaatacatagaaagttgactcaaaatgttttctgccacgatatagcagataactggatgatattttggatgataacttgtatttatttaaatttaggaagaatcagcattacatgcaaattatgaataaaatttaaataacctaacattattatttaagaccattaaaagtaattcatttgtggaacctaatgttaaagaccagcaaatgtcattgtggactttctcagtggagaaaaatctctcattttctgttttcttacagtatcttcccacgagtgcctcccaacagaaagaaaaattaattgaatatatcttaatagtgatacattttgagctctgaaaatagattggaggtaggtaaaatttgcttcatgtatatacattcatcaactagcgagatgaatagttattagattagaaaatatttttgtttcattttattataattgagtttacctcttttagtttttagaagagattatttcatgcttgtgcttctcacaaaaagttgcaaaatgtaaagagcatctaagataaactaaaagggtagcattttaagtaacactaaagaaaatggatgaaaggcatttttaaggcagggctctgaatgtcaccagtaaatatattccatgaaggtttgggtagatcagtgcataaagatccggctgctaactttatcctagttctggtgttcagaaatgcatgttgcatcccttttctctgtaatcatacccattatcatgattttgaaaattacaggcttatatttttcaagttcctctgtagtatagattgtctcctaagaatcagaactgtctaattggttctccaacgtattcacaggcacctcaaattcagcataataaaaaatgacttatttttgcattaccttgtaaaagctgatagggctcaacaaccactcaatttagaaacacaataccacacataagaaatatgaaatgtttcccttttctctctgtatctttcccatccctagttactaggctctgtttatttgaatttcatgaattacttttaaaaccactgtctattctgcctcttcatccctaccatcttaattcagagcattaagaatcttctgcatttattatagccacaaaactgattgatctcttccagtctattttttcacattgccaccattcttagttttaacgtatgtatctgaggatataattgctaatggaagacatcccaaaatatcttcatatggaatgcacgacccttcattatcagactgtatctaacacctcatcttccatcaggatcttctggaatatcaaaacataacaagctccttaaaatttaccaaataaataggttctacacactactttatatttctatcaacaaacatcacactcacacttgtgggtttgcattgttaatgactaacctagattctagaatcttgcaacccaggatatatgtctcatttatctacttgtcttcactgcttagcatggtaattagcatttagttggcgctattatattccataatttctcaatttcataatgtgttttttcacaacttaatgtttctgggatgtcttataattattgtataatttagagcaaaatgtcttcttttttccttgaaaatgttttggtaaattaatgacagatcttgcaatcaagggtaacttagagtcaaagctacgcatttatggaaggaagagaaaaaatgagagttaaaggtaagaattaaattattctaactaaaattaaatgtgtttatggaaccaactgataaaaatattttatatccattattttacataaaataatttagaaagtttttgaaaataaaatatttgggaaaaaaatattaaacttttcctcttaagtggatgaaattgaaagggtaattatttccctaagttaatacccaaatactcatattgcaatgtgggacaggaagtctattctgattcctaagctatatcatccaaaatgtaaaataattccttctcctttatggtgggttgttctagagaattctagagtagctgtgaattctctattacatcatggatcagatcagtttgcaaaatggctcgcctgcttaaaatataaactaattacccagcaacatttataagactgagatgccacatacagaatagagcaataatacatgggcttatcagtgacttttcaaaatgtgcattaccaaaaactgaattatactgtttactttttattactttatttcatcctctttctattgaatttcactgtattaacaaactctattattcagaaaagaatacagaagtacacatcagaaaatggacatttagagtcatgtacatttaaggctcggttactgggtttttcacattcagtacaaaaactgtttcttagaataaatttcctgcagaaaactatttcaggaatttcaaagctagctatatactagaacatacacaagagcagaagtgatttcgaagaggaatcaacgcacacttgacatgaggggccaagcttctgagaagagaatcaaggagagccctaaatatgttgagaatacgaacgatgaaagtcaaagacatgatctccttaaataattaattatttagccaggcatggtggctcatgcctgtaatcccagcacttaggtaggcagatgtgggaggataacttgagaccagggatttgagacttgcctgggcaacattgtaagaccccattcgccacaaaaagaaaaaataaattaataataattatttcaagtgttaaaatattttgcaagaacaagagcagaaataaagacaacaaaatattctttttttctttagaaagaaaaacataaatggaaaataatgccagaaagaaggacaaggaagggaaaatgaaaatcctcagaagggctaaatctgtgagcagatctagattaacactgattaaaaaaaaaagtatgtggttcaaaatataagtacaattaacacaaatgtccataatagttcatgatgaggtaggcagacagagttaaagtagtgtagattccagtataaagtctggaaattagtacgttttatttaaagtcaacataaataacttaaaaattcattttgtgatctcttggggaaccactaagaacattttataaaggaattaatactaacaaactaataaagaggaaatacaaaagatacaattaatccaaaataagctacaagaagaaaaaaatgaatgaaaaccatacaagaaaaatacaagtacaaactaaaaaggtaggcatggacctcgattattattaattaaactaaatataaatgcactaaatacttcaattaaaagacaaatgtgtctgaaataaaaacaatttaaaaataacttttacaatttaaaaaatgcattaaatataaggacacaaaaagttgaaaaaataaagcagaaaaatggcttagcatgcaaatactaaacactagaaaattctgtgagtattctgatatcaaagtaaacattaagacaaaaataattgctaaaaataaagaaggacatttcatcgacaggcttaattcaagagaaagaacacttttaaatatgtaggcacctaattaaacaacatcaagtatataatgtaataactatcagaattgaaaggaaaatgaacaaatgtaaagtcatagttgaagagtttagcagttgtacatcaatatctaataggacaaaaaaaaaaaaacaaaaggtcaagaaggctatagaagagatgaacaaaaaggttaacaaactgaccaaattgacattcatttaaaactgcaaccacaagttgcagaatatacattcttatcaaatgcacacagaatatttaccaaaataggccgtagagtaagtaataaacaaatgtgaaaatgtttgaaatatacaatgtttcctcaccaaagtggaattaagttacaaataaaatttttaaaaggagggggaatatccaaatatgttcaatttaagcaatgtatttccaaatcacttatgggtcaaaaagaaatcaaaaagaaaattagaatgtactttgaattaaataataataaaaagagggtatagctccaaacttctgatatgtactaaatctgtgttccagggaaattcatagtcataaatgcataaattttaaaataagaaagactacaagtcgatgatctaagcatccactttaagaaattagaagaaagagaataataaaaataagatggacaatcaatataatataaaaatttaaaactcaaaatttaaaaatatctaatgctatttttaaaacaattaatattggattagctcctttagatttttcttttttaaaaaatagcccaatatcaattaactttctggagtttgggaagaaaaaataataacacatgtaaaagccttcaacagtccctggcacataccgtgtactcaaaagattttagtttgtctcccattcacttttccctagcagataaacattgaaaccttcaacgttagctgtccatcaatacaaaacactctagtagaaagaaaccttctttttctctgaaattaaaatacatctcccacttctgggtccaatgttctgatattactttttaatttgtactggaagtatcagggaggctgagaaggaatggataggaattatgtgtatttattgcaggaaatataaattgttaaacataataaaaagaaaaaggacaggaaagtaagcaatttgccaggtgctcaattcatcttttcattatcccttttctctgaaaggaaagtgcaaatcgttttcctttttgtgacactgtcttatctactgcaggagccataaagatgaagataagaaagaaatactctgagagtatcatgataaaaaatcagaaaaaaaacatgaaataccagatttttttacagcatacacaaaatattcatgcgctaaatgtaaatctgttatcctgacatacattaagtgtctgctttttaaacatcgcctaagactacaggtattgggttcattttggagacctgagaatattattcagcagtagcttaacaaatttcagtgaaaaattaagcagatgaaagtgttttcttgggccacttcctccatatgtgagttggctgcagctgccattgtacttactttgcatgtttaatttgcaaattagcaattgagaaagataaaaaacatgagctttgttctgttcagttaaacaaacatttgttgcccaccatgtgccaagcattgggctggatgctagaagaacccagatgaatgagagcaagtccctgcctcaaaagacctagtgtacttggcagggaggctgccaagtcttccaaccaggatgacacaaatgtgtggttcacagaaatcctcataacgagaacattataattattcctaggatgcataagaatcactcaactatggaaagataagattggcagaaagtgcaaaataaccaaatacacaaaatattcaacatgctgtggggagagaaataacatcaccactgatattaccaaggtgtacgttgcgaagtaagaaaaaatgttatctgaggctggagaaggagatgggggtcaagttgggaagacttcttcatgtgaacaagtttgagtcttatttattcagagtggcatagtcagatttatattttagagagatcacgctgtttatagtgtgaatgtggatttaagctgggacaaggcttgaggcaaagaaataaggtgtcacctttaatagcccaaaccagagatgaccagggttctcattaggaccttagaatgagtggcaagagtaaataaaagaaaatcaattcatcacctgctaaactgaaagtggacattttgagcacttccagacaaaaaggctaaaatttctatgtaattcatatgaacaacagctttccccaaaaaccatacattccgattcagaaagtatgcattctagattgctaaaagggagagaattagtatgtgatgggggaaacattatgaaaaacaagaaacatgatctaaacaggggcattgtagaatcactttctgcagctcctcttgactaggagttttgttaattctgtagtaaaaaagtattaacagttatgatgttaacttcattttgcacatcttgggttgccaatacattaacctgtatataaatgtacaaaattatgttcaattattctgcaccaatgctttgtgtgttctcttaaaagaccagatttaaaatctaattttttttaaatttaaagatcaaaatctgcagcaaaaaatggcatttggaattcttataggtaagtttctgaagtgtgtaacccatcataattagaatcaagctcctcatacccaaaatgagtagatccaaatatctctaccctttagagaatggatcatttttgtccaaggactttgattttgtatttctaaacctatgccaaatctgatttggtcttaaaaaaacaaagagtttcttagatcaactagatgataaggctatcttctgaaaaccttaaatgctagacataaggagagttcgggcttcacaaactgatgtgtgtttatctctgtggattatcaatataataactgaactgaaaatcgggaagtgaaccttgttgctttgtgtgatgattagcaagtactataatttggaaaattgtaacccattaagaagatagtctaaatctcttgtcatgcacacactgcaatactcaaatacatttttaaagaaagaaacctaggctggcatggtggctcacgcctgtaatcccagcactttaggaggctgaggtgggtggatcacaaggtcaggaggtcgagaccatcctggccaacatggtgtaaccctgtctctactaaaaatgcaaaaattagctgggcgtggtgacacgtgcctgtaatcccagctacttgggaggctgaggcaggagaatcgcttgaaccgaggtggcagaagttgcagttagccgagattgtgtcactacactccagcttggtgacagagcaagactccatctccaaaaaaaaaaaaaaaaaaaaaagaaggaaccctaagacatagtatttttcattgctgtcataataagactgaattaaatattacatcattatgagggagtatgaaatacaggaatactgctatacatacagtagtatgcactatgctttaaatagctctaaatatctttcaaacatattccaagatattgtgggttccattccagcccattacaataatgtgaatattgtaataaagtgagtcacacacatattttttgagttctcagtgaatatgttatgtttacactatcctgtagtctataaaatatgcaatagcattatgtctaaaaaacaatgtatatactttaatttaaaaatccttcctaaaaactgctagcgatcatctgagccttcagcaagtcttaatctttttgctggtggaggggcttgcttagacgttcatggctgctaacagatcagggtggtggttgctgaaggttagggtggctgtgtcaatttcttaaaataagacaacagtgaagtttgccacattgattaactattcctttcacaaaagatttctctgtagcacatgatactgtttgatagcattttacccatcaaacttctttcaaaattggagtcaatcctctcaaaccctgctgctactttatcaactaaatttaaataatattctaaatttttacaatatctttgccaagaatagattctatctcaagaaaacttttttcattcataagaagcaactcttcatccactcaaattttatcgtgagattgtagcaattcagtcacatcttcaggctccatttctgattctagttctcttgttctttcctctatatctgcagttacttctgcactgaagtcttgaacccctcaaagtcacccacgagggttggaatcaacttctttcaaagtcctgttaatgtcgatgttttgacctcctaccgtgaataatgaaaatgttcttaatggcacctagattggcgaatactctcctgaaagtttttaattgatgttgcccagatatatgagagaaatctctacctacggcaactagtcttacaaaatgtatttcttaaataataaggtttgaaagttgaaattactccttgatccacgggtttcaaagcagatgttgtattagcaggcatgaaaacattaattgccttgtacttctccctcagagcactcgggtgacaaagtacattgtcagtgagtagtgatattttaaaatacatcatttttttctgagcagtaggtgtcaacagtgggcttaaaatatccagtaaaccatgccataaacagatgtgctgtcacctttgttattctgtttatagagcacagacagagtagattcagcataattcttcagggccccgagatttttggagtgataaataaacattaaagttaccagctgcattagtccctaacaagagagtcagcctgtcctttgaaactttgaagccaggcattgacttctcctctacagctatgaaagtcctacaggacatcttccaatataaggcaatataaggatgttttgtctattgaaaatctcttgtttagtgtagccacctccatcaatgttcttagctagatcttctggataacccactgcagcttctacattagtacttgttgcttcaccttacaatttttatggaaatagcttcttttcttaaacctcataaatgaagatctgctaatttccatcttctcttctttaacttccccccacctcaatcagccttcacagaattaaagaaagttagaacctctcttctgggagttggataggaaaatggctgaagcagtgagaacacatacaacttttattaactatgctgtcttatatgagtatagtttatggcaccttaaaataatatagtattagattggtgcaaaagtaattgcagtttttgccaaaaaaaaggtaatggcaaaaactgcaataacttttgcattaacctaataactttgataatcactgatcgcagatcaccataacaaatataataataatgaaaaagtttgaaatattgtgagaaatatcaaatgtaataccaagaaatgaagtgagcacatgtcaacagtgagctgttggaaaaatggtgttaacagacttgctggacacggttgccacaaaccttcaatttataaaaaatgcactgtctgcaaaggctattaagttaagcataataaaataagatgaagtctgcatgtgtaaataaatgtaatatttaactttaaagcatacagaagatagctttaaaatgtatagtaatgtgttctttggtatcgtttatataacttacattttgatatgtttcatttctctgctcaaatatcgaagcagggtataactttatatcttgacccccataaccacatatttctgtaggacaccacttacgaagaatgcatatgtaaaaagcgatggatgtcatcaaatcacccttacttttttatatttacataaaatgtcatgataatcagggtgtgagttcctctttagacatccttctgagaactattttatgacaacttccccacaactgataggccagcatgagttgtcaagagaatggaaaagctgcccccacatcatctatgccttctgtgtcctttgtggtctaactacatcctccaggtcctgccatttcacacttggcctatgtgcaatgttcccaaagctttagccatttcattttgtacataaagatcagattccacaactgcattctgttaaaaatgtcctctaatctttattcgaagtgaacctattgcttttttttttgagatggagtctcactttgttgcctaggctggagggcagtgtagcaatctcggctcactgcaacctctgcctcccaggttcaaccgattctcctgcctcagtacccccagtagctgggattacaggcgcatgccaccacaccctgctaattttgtatttttattagagatggggtttcaccatgctggccaggctagtctggaactcttgacctcaggtgatccacccgccttggcctcttaaagagttgggattacaggtgtgagccaccacacctggccctaagtgagcctatttctaaaccaaagcatggaccttgagactaatgagggtaatgatgtctaggggcccagactttaatgtgtaccggagcactcttagattgaaaagtagaggatttcctgagagattctagagacaaagttaacatggtaacatggaggaggttataaaagaaagtgtatgtatattaagagttaagagttgggtttttctattttagcttccttttttttgacaggggtctggctctgtcgccaaggctagagtgtggtggaccaatcttggctcactgcaacctccacctcccgggttcaagagattctccagcctcagcctcctgagtagctaggattataggcatgtgctaccatgcccagctaatttcctgtatttttagtaaagatatagtttctccatgttggccgggctggtctcaactcctgacctcaaatgatctgcccacctcagcctcccaaagtgctgggattacaggcatgagtcaccacgctgaggctattttactacagcctcctaactaaagcttttaaaatagttccagatgaaatccaaagcaaaatatcattataattataatcttcagggaaattcgtttattcgcagataaagtatatgtgttgccttctcagtaataaacatcatagattaaattgtaatacattgcaaatgtgagacttgagatgatatgatcagcagaagggggaaaaaagatgtgcataatcttgtatacaatttatattctaaatgtctgaatacactaacaaaaattcaaatacagcaaaataaaatgctttaaagagtcataaaaatgaatatgaggatatgatagcatttagtatcatagagaatgtagaagacatgaaatatcataaaatataaaatatagacagaaaactgattgcataaaataattacatttaggacatatgaaatgaaaatcatggaaattacagtcaatcagtaaaattattttcttaaatttctccttaatacctagaatggcaacttattttcccaaggatactgtaggaaaaatattcttttgtttattttttgtcactaatcttatgataatttaactgtataaactaaccatatattactgtaatattgaacatgtttatattcagcaaatttcttagactccacagggttaaatgatgctatctataataagaacacctgtattaacttggggtttctggagagagagaggagctttttccagccgacttgccaaaaagctgaatctattctgtgcaaactatatgacagatcattctggaaaactgagagctaatgtagtattacatgtggttataccatggacagttgatagagaatgacccggagtcacacgatgcacctgtttttttttttgttgttgttgtttgttttttggtttgtttgtttgttttacaattcaaggaaaatgaaattgtatttcatcatggagaggaaaaaaaggaaaatttttaaacattggagaaaatataattgagggagcaagttaaagtaaatgttatccttacaaataatggctgacagaatttgctctatttttgagagcattgttaaaacaaaacaaacaaacaaaacaggagtcaattgatgttagctccttcttccctggcattttttatcctgggttccagtcttgtctaatggtaccaggaagtacctaattgctgaaaactatggaaccttcctgtttttctcttttttcaacatttccacatactaattcagtctggtctacctagtaattttatataattgtggatcatttcttacttaggaagatcattccttctatcatcatttcttgcatagagtgttgccttctaactagtccaagatgatggtttgaaagtgaaatattttcaaatccctgttctttgtggagctctttagtgtccttttggccttcctgtgaccctgatgttataatctaagcctgctggtggacagcacactaaacagttccctgatttaggaagtgtatctgcaaggccgagcctttttccgtgctgtcctttctacttggaactctcccatgtttgcctaattattgtctcctggtctttcaaaccagtcacacttggtcccttcatcttcctcaagcaaaatgtggtgatccctcctctatgctctaaaaaagtcggctccaagaaggaagaattatgccaaagaaaaagcctacaagaagacatatttccagagtttgaaggttggtttcaagtccttgactgctaagaatatccacttttgacacataataaagcaaaccagcctttatttctatcttcttctatttgcttatatatctcttacatgaaattaaaggacaaagacctcttcctgccttttaaactgtgttctggagcatctccaagttggttatgccatcttcctctcttaaaagggatttggggcataatctgaatagtgagacaaggcaacagcttacttcatgaagctgtgttaaggctccatctgcagagagtgagacgactctgtccaatggttcgaaaggaaaacgtcatgcttgacaacgtgtgaacaactaaagacagaatgttctctagttttaggaagaatcatttaatcaattccattagtattcccatgcgctgaaacatagtgtctacatttcccatatgggacacagagttaaaacccacagggatgaattcatttccagagatctgcaactttatcgttttgtctgttacaatacatgaaacaatcccagcgattttcaacatcattaatatttgatgttccatgttcgatatacttcagttattcttaaccagaaaaagagtttaattttaccatgaaacatatatctacataagctaaaaataatacttagtgatgtttcatatttattatgagaaagctgttcaaaatgatgagaaagctgttcaaaatgatcagaaagaaattataaagatactaacacagtcaggttaataaaagtcacatatgtatagagaaagcataggcatattattaacttagattgcaaataaaaatatcaaagcaaaatggactgcagataatgatgttttatggatgaaaataggaatgcaattttaaaaggaatccaacaagtaaacagttgtagctgaattgataaactctgaaacaatgtgtttttaccttcataaagttccctagttgaggtcccagttatcaccctcccttcactacatgggaaattgtattctttggcatttatattctaattcttctttatattccagcaaattatttgccccctcatattttaaactaacagcctccttaatggtcttccaaattctgctttctttactttccaacccagcatgcacacaattttgacatatttttctagaaatcctatttccatttttagtgtatgaatcaactaaaatacaagttactttgtaaggacctatgttaatgtccaacaatttgatcatggtgtgccttctccatcaagcatcagcctttaggtgctccatcatctactgttcccttagcaatggtaccccaacacataccaacgcaccaggtaggtccaatcttcataaagggagagagcattttctcctcagagttttacttatgtcaattactccaactagaaaaatctatgctccaatctatcaattcacttgttcctaattcacctattaaaagtattaccaaatcactatttttcaacatatcttaataagtaaatatttcaatgacttcttagtcctaatcccttcccatgccctgctaattcccactaaaacactgagtgaactgtggttgaaaataatgactattggctagatgcatgggtatgtgcctggctggctgaatcaacagtctccttgatatgctcaagttagttggcttaagtgacaataacaacaacaacaataacaagatccttggtttaagggagagggattaaggtattgaaaggtggatgtttaacacatgaaaagtagatccttttgatcccaaaagtaacttctcagcaaaaaaagataaaagaacatctaaggataaaaatatcccaaacttctaactctctatatacaaatgggttcatgttaaatttgtatttctatttacataatttaaacacattgtgttcaattgcaaagctctaacctaagtaggaatagtaatcccaaaatgctcaatgttaaactttaggactacattgtttgtaggtattttctttcaaagttcatggttatttacttctaagcacaataacactcaaagtaaaggaggaatgatagccaaggccagtatctagaagtacattcacatttgttttacctacaaatagaatgcataatccagggacacagacaaggctagtgtagagctgtaaattatttatctaattaaaatagagataattcttctgccttcatcttctcagctatttattccagatgtcagtgcacaaccattctattccaacaacaaagtgaaatattcattgatttgatattcctgttgctctaaagcaaatacatctcaatttctgtgtcctttccttccttcctctctccctctgtctactccccccacaacacacacgcacacaattacacattttgtaggcacttttcaactatgtctcaagaattaaagaaaaaaatcttcaaaaaaatttttttgtgtaatttgaacattataatatcataagggaaaaataaaacatttaacctttcttaattcaaacactttcacacttgtatcataacaacatacagacccaaggaaatacaactggttgttgttacagaagaaaaaagagaataataataatgtagaaacaatgtggcatttctggttgacaatgtgataactgtactaaaagatgtcttaaatgaaaaaaaataaacaaatatggtatccttagctatacctaaaataacttctattttcttctctgtaattacatgaatgctacagaattaacattttaaggtttcaaatgcagtcagaaagactaaacataaaatttaccttatagctttcaagaagcaaaagagatttttcaattctaaaatgaatctctgtaatcatgcaatcaataataatattttcaagaattaaggttcagggtatctgaaatgtttatttatgttctaacacattaaataggaaataagaaaaactaactcattttccttaatgtaaaacttcaatctagtggtaaagaaagtataaatttgcttctatttcaaaattgcataaaaaagtttcctccaattacgttggtagtacttacttctctgcaagcccaacagacaattgcctgggaatagcattcacacacaacctgtgttgtaggtaattatgtagtgttcctggatgagtcaaatattcatgtaatccacctacctaggtcaaatgaatgaatttctatttccattcatcagcattttacttgatggcttctgtgtgtcagtgactacaacgatctcaggagatttggaaagagtaagtcatagtcattgacatcacaagacctgcagactatgaggagagaaaactgaagacagaaaggcaaaccaaaaaaggcaagctttgtattgagccttgaaaaattagttgctgttcagtaggtaagaaagaagaggaggagagaagatttcaaggctgatcatatcactataggagctaaggtctgatgtgttaggaatttcaagttatttaggtgattaagatctagcatgttctggaaggtgttaggtgtggtggtggagggagtggtaagacttaaggaaagaagagagagtagggttatgttgcaaggtagtaaggagccactgaaggatcctaagcataggaggcatatgctcacacttgcattttgggaagaatgctctggaagctctctgaaggatgggtttctgatggagtgatggaaagaatggtgaaaacatagagattagcaacacagttcagtaaaggaatgacaagagttgagttatggctgtagcaatggcgaggcagaatatatggcaatcttgaaaggttttaaaagttagactccatgaaacagtctggctggtttcatgttgtgtgtgagggaagaaaagaactccaaattactgacagtactttgtttatgagactaaggtatggtggaaccattcattgggtttgacaggataggacatggagccagtagaaggaaaagcacagacagacataaatttgagctgtcactgggacgtaaaagcagacatatctaatgggcagaatgatgtgtaatctagaagaagatctcagaactaggtatatgaacttataaaacacctgtacacggtggaataaacacactaaataatatatgcaatcattaatagtcatgcacttcgaattagtattaaaaatactctaggtgataagcaatagaaggacaagtaaaatcaattgcccctttgataaaatactgacatctcaaagtaaattgagatcgtaagcagacaaggcaactctggggataaagagaatattagttatcttatgaagaaagaggagctaggtaatgaaggcaaatatggggcaatgggtgggtttaagaaggcgaactggaggctacctctgggaatgtgtagcagctagtctccacgatgactcccagggatgcttggggtattcatgcccttagatagtctcctccagcattgcattaggtgttatctgtgtgaccaattggatgtgacagaggtgacagtgtgcccctcctgaggccaggttatacaggggagtgctgcttcagtcaccctaggagaagtcagagcgaagctatgaggaggcacaggcattcccgtctaaacacacacatggagagaaactgaggactccccctgagagccagcaccagccatgagcaggtgaatgaatcaccttggaagtggatgctccaaccctgccagaactgcctatgactacagccaccattcacattttatttcagtctcattaaggaccccaattcagaaccgtctagccaagccactcccaaattcccggcccacagtaatcgtgggatataaaaatgttcgttgttgctttatgtcactaaaatgtattacgcctggataagtaactaacaagcacaatcatgatcagttactcaaatggggaatatacatagttccactagtgcttttagcaaagactaggttcaaaatgaatgttctcaacataaagtgtatttcttagcaaggaatgtaacaacccatcatgtacacaatcagagattgggtaaattggtttttaagacttaattttaaagttcaaggaaaaagacatgtaatgagaagagtatctgagagaatcatatgctcattagaaagcattaccacgagaccaaagagagggagcagccctgtatccaagaaggaagaagggtaacacttggttgactgaacaaagaaccattcatagaacccgaataagtataaaaatgtacagataataacatgtttgaacagattagccaagaaatggaattaaaagtaggttaaaagcctaatatcatgataaaataaaactgcagtgacataattgtaaatatgttatgtaacctaacatttacaaccaaagcagaagaatggagaagtaagtgccatcacacaatggaagaagttcagttcctggagtaggaaaggcctctgccagttgtggcccttcacttccccagggagtgatccaaagtaacccattgaacctctccaaatctctgtttcctaaattaaccagagtcatctgtaagagttactgtaagaattaacatttgtattacttattttaaaacatacaacacagggctgggacaaaaaaatgcttagtaagcaatatattctcttgtttattccatttcttttttaaaaattggaaaaaatataaagtgccataagaaaatcaaggtattttgctttctcaacagtagcatttttacgaaaatggataacaacttttaagacatcaataaggaatagcaagtgatatgatgaaagtcgtaagtttagccagattcaattaaatctgttggcttcaccaattccaagcatatgattatgtatgtaaaatagctttctaactgtaatgcactgcctaaatgtggagtgttatttaggagacactggcagagagtgtcaattgatccaccagtgagtaaatagcaaattaaatctaaaaatgaccgttttttatagatgctaaaaggaacattgagaaaatttatttagatttacagaaacaaagaatgtttttccaagattgttcctggggttgtaacagtaggaaagtcctagtacataaaaataaatacaagatgctgactacatcctgctgtcctctactgaggcacagcaggggatacaaaatcacacactgaacatgcagtttacctccagtgcccaggaggcggtcagctttcaattttgtttttaaaagggattgcaacatcaagttttatttccaaattcatgctaatttatgcaaggcagacagcctcttccattttgtggcaaaatgaagtcacaaaaattgctagaatctactctccttgagacctcagctgttttcagtgtctagcatgcagcacacagttatactattctaaaaaacaatattgtgcaaaattaaatctttagttcatgcaatcagccattcaaaaactattaagtgtccattgagtgccagcaagtcaggttacagatgctcttgaaggcatttctgagaccgcaaatctcactgttagtgtctgaatacagtgtccagttatttgctgtgtgtagctgtatgggtttttcataagtggttatctgcctcatgatgatggttttgtgattttgataaagggaaaccaaactaaacaggggtttgaggaatacggggggggcaagagaaaatagtgatttcaattatacgtagataattcttcaagacaacttagcattaaaaatcaaatatcaagacaataagaggttaaactgtaaaaggcataaaattttctttaccctttttctcccttttgtacatagcttgctaaataatttttgttatgaatttcaagggtcttttccttttccttaaaaaagacttccaaacctatgctggcaatcaacctatgcaactccaacaagcaattcagtttatttaatgatagattatgagtttaaactcatatcatgtatttgaattgaaaatgtagaggaagatacaaatctatgaatggtggttatcccagaaatgaacactggggtttgtgaagggctaaattgggactgttaatttgtttttataccatcccatagcttttgaaattttaccatgattatgtatcactttatagtaaaaatttaatctctaaaatatgaggaattatgtattaatgaggggatatagcaattttctccttcataagaaagagattatcttttatagactattaccagaaagaatacaagaatgttatgttttaatctaaatctggctgggtgcagtggctcacgcatgtaatcctagcactttgggaagccgagacaggcagatcacctgaggtcaggatttagagaccagcctggccaacatggtgaaatccagtctctactaaaaatacaaaaattagccgggtgtgatggtgcatgcctgtaatcacggctactctggaggctgaggcaagagaatcgctactgggaggtggaggttgcagtgagcggagatcactccgctatactccagcctgggtagcagagtgagactccgtctcaacaaaaataataataaaataataaaataaaataaatctaaataaatacatctaaaacgctttctcctccaatcaaattgatccatgtgtgtacttctgaatttttgacagttcccaagtgattcccaagaataggtaggtgtttatggaaataaatatttgtgaaattcaaaatgaagaagcaggtgtataagatgtataagaagcaggtgtataagatgtataagaaggcatctgagaaaagatgaggagacaagcaacacaacaaccttgggggactatttttatctcttatagctcttcacattataaaactctaggacattttatgaatatatgctcaaaagactctcatgttgaggaaatatgttttagaggtttaagatatattcaaatgcagattataaagattaaatcaagattccaatgatgattataaattacatgaaaatcatgggaaaagaataaatactcttcatataaactgaaaaccatagggaatatttataaaactagagctccctgagtagtgaattattcagtcattaaatggatgcaggtagagagagagagagagaaatagatacagagatatacaccgagatcttcctgcttaaggataaaacaacagaaaataggactcttagaatgagaaatgtttgtctgggtacatctgaaatataaacagtaataatagacaatcaaaaaacatcttgatgaccacagaatgactgtgacattagaataacagctaacaattattgaaattgtattttatactaagcctggtattaaggcctttttatttattgttttatgtaattctcataaaaacttctaagggaagtgctgttcttatcccagagttactgagggagaaagttatgtatcactttgagaagcaatgacacagtctcagagtcactagtcaagatctacactgagctagaagtgagtacttgctttagcgcaaaaatttttgttttcaagatggatcttgctctgtctcccaggctggagttcactgcaacctctgcctcctgggttcaagtgattctcctacctcacaccaccatgtctgcctgtttttgtatttttagtagagacagggtttcaccatgttggccaggctggtctcaaactccttacctcatgatctacccgcctcagcctcccaaagtgctgggattacaggcatgagccaccgggcccagcctagtgcaaaaattctaatcgctacactgctgcatacaatatgatctccataaatatgtgttgaatgatgtcacaatgttactataacctaatgctataaaatacagcaggtgtccttctaccaatatttcaaatagacattgacccacaattgtatttaatctattttgccgcaattaaatagttaagtaacagatttaaaatgtaggatataattatttggacatctataatttaataattaataatatactaaaaggttttttaaagtaataaaacacctgagtaatgtctctccattgacaaaaaaataaaaataaaaatcataaaatctaaattaattgaccatttctagtctaggaacatgataaataacatcaacagtttctcaccagccaaataataaactttttttttttttgagattgagtttcactcttgttgcccaggctggaatgcaatggcatgatcacggctcactccaacctttgcctcccaggttcaagcaattctcctgcctcagccttccaagtagttacgattacaggcatgcaccaccaaacctgcctaattttgtatttttagtagaaatgaggtttcactatatgggtcaggctggtctcgaactcttgacctcaggtaatccagccacctcggcttcccaaagtgctgggattataggcgagagccactgcactgggccataataagctttcaatgtctgaaaaagattaggagttcttcagatgcaagtgtcctcgtctaatgtgctttgaattcccttggtcattctacgcttacttgacacttagtatgcattttatgacagtttgctaagtttttaatatagtgcagggatgccacttaatattatcaacaaacacaaaagaaattcagccaagaacatctataattggtattaataatatattgctctattgctcatacaacatgtttgccacatttttattcactcatttatttattctttcattcattcacccaacaacatttagactagcactaacattcacaatacgtcaaatattgaagccataggggtaaattcactatatttagcatcagcttgctagtcttttatcgagtattgctatgtttagtatgaaatgtatttaaactctgactgaaatcaataaaagacagcagacaaaggatttaaatgtccgaatctaagtattcacttctagacagataaaatattattcatgaatgttataaaaaggcattcgattaaaaaaaattatgggaaagtgattcccagtgggtaaacaaaacaaaacaagaacatatgcgcatctgtgcaattggccacacgtgaaaatgcatgtctcaagggccagtgcagatgattgctttttctttccccacaacccccagggtgagtgtctaattcagacactaagaaaaacagaaataagaaacaaaatggattaaagtagatgcagccaatctatagagacagaaactagattgactcgtggttgcgcgggactgggagagagggaagggaaatgaggaatgactgctaataggtaggaggtttttctctggagtaataaaaatgttctaaaattagattgtggtaatggtttcacaatgctgcctgtgttctaaaaaccactgaattgtacacattaattgggtgaatgttatatgtaaaatatatatctataaagttgttaaaaaatagatgctgctagttttttcattaacaataactacttttcaatacattttcaattatttttatttttgaaaagtatttcagatttttatatttttagtaaagatgtagtttcaccatattggccaggctggtctcgaactcctgaccttgtgattcacctgcctcggcctcccaaagtgctgggattacaggcatgagccactgtgcctggcccagaaatgcatttttaaaagccaatctttcccttctggatgaacatcaatgaactcataaaattagtttccatcctgtgattaccatcaagtattttgtcttttaatggtaatattatttttatgaatcagattcctttgactaatttactaaaattttgaggttttaaataagcataaacccacttaaggaccaatgaaaattaattttattttccccttattgataggtcaaattcttttatgtaataggtcctcattaaatgcagtttatctagggaaaaatgcaatgataaagaataaccccagattatttaatagtaggctctttacttaacaatatggaatagaacattgtacgtgtcccagtaataaactaataacagtgatttcttatggaattagatctactatcagaaaacaggcttttttaaaaaaacagtcttctatatatccaaataacataatttaatttaaatttgcttttattctccagtgaaaaattttcaatgttttaaatcctaaactactgctgatattaatagatcataataacatctttgtgaagttctgcagttactgttatcagacttattttctgagtactttttatgcagttatcagaaacatgattttggaaatgttgttttagtcaataagtaacaagatcaaataaaatattttttggtcccttttgtactgaggtaaaatacacagacacaaagttcaccattttgaagtgtacaattcaatataattggtgcattcatgatgttatataaccatcaccactatctaattccagaacgttttcatcatcccaaaagaaaattttgtatccattaagcagtcctgcctcagttcctgcctccctagagcacctaccagtgactcatctgctttatctctaaggatttgcctatcccgagtattttatataaagggaatcatgctacacacatgcttttatgcctgacttctttaatttagcaaaacgttttcaagatttatccatgttgtagcatgtatcagtacttcattctttcttatgcttgaatgttattccattgtatggatataccacattttgtttattcattcatcaggtgatggacatttggtttgtttctactttgtggctatgattttagcagtacatttggcttgcttttctagataacgtatgtcatgtgataggcttcttttccaaataaaaattaagaaaataagaatacaagatttggggaaaactgttttcattctaaacaggaccaatacctttccagtatagaactcatccttcatatccaaagataaaatgtatatcctcaatgaactatgaaactcactgtttcaaaaacataataaaaacatcagaattgatagccaactacctccttgacatattgattgggatatctggtatacatctcaaacttaatatgccccagactgaattattttatttgcacatccatattaaatttttctttaaccttctcctatagctccattctagtgactcaacccaaaggcattattattattattattattattattattattattattattttgatacagagtttcactcttattgcccaggctggagtgcaatggcgccatctcagctcaccgcaaactctgcctcccgggttcaagtgattctcctgcctcagcctcccgaatagctgggattacaggtgcacaccaccatgcccagctaatttttgtatttttagcagagatgtgttttttctatgttggccaggctggtctcgaactcctgacctcaggtgatccacccacctcggcccccacaaagtgttgggattacaggcttgagccactgcacctggctgcctggtagccattcttagcacactcctttcctccctaccaatgtaaagtccatcttcaaatcatatgcaaacagcttgacctctcccacttttctttattatcactggcattgcactagaccaaaccaccattttacttggactcttccttcttgccttgaccatcttaagtttattctccaccaaaaacagtggagggaatctcttaagaatttatttttattgatatattgtagttgtatgtattttgtgagtacatgtgatattttgatatgtggatatgacctgtaaagatcaaatcaagataattaggatatccatcgcctcaaacatttctcttttctttgttttgacaacattacaagtcttctcttctaaacatcgtaaatatgtaataaataattgttaactataatttccctactgtcctattaaatattagaatttatttcttcaatctagcagtatttttatacccatatgtcacctctttgtttcaaatcttttagagacttcctgctactattaaaataaaaacccaatcctcgctatgacctattagtctctgtatgatctgatctcagacttgctccccaaattcacttcctggctctcttttcatattgccccagtgaaatcaacctttttcacatcttatcggcaccacactgttctagaaccttctcaaatgctgtcttaatgtgtgtgtgtcctccacacacacctaaccattctccgtttaacaacgtcctgctcattgttcaggcctctattcatacatcatattctccaaatcaccttccaatacaaatcagggtgccccaacattagggtgtcctttgaaatgaactgaaataatttgattctttatgattcattattctgcattgtttgggcctgcttattagtataactactcggtcctacatgagactgtaagcccagtggggattttcacagtaagagataaatattcttcgtttaagtagaaagttcatatggcacttaagtcaatgttattctttgatctctagaatagttcatgtaattaaaattttcataaaatactaaaattaggactagtaattaaatcaactttattttatcccttaagttttatagatgaagaacacaaaagggttagaaaggtaagtgattctgaaatgcagcagctctaatcatgttaggaaaacattcgctcagtaaaataagcctttatctggaggaaaaaacctgaagaaatgtcaatccagattaaatgagtgattccaattaaagcaatttcaatttacactagtcagttaagttttgatcactagcttcattttgcttttgttgttgtgcctgattgcctttgatatattaacttataaataaaatggatttagattgatctaatatacctatcattgatgcagtgctctctgcagagcacattgtctaatgatgtgttagaagatcagtgcctccacttactctttttttttttttttttttgagacagagtctcactctgtcacccaggctggagtgcagtggcgtgatctctgctcactgcaacctccacctcccaggttcaagcaattctcctgcctcatcctcccgagtagctggaattacaggtgactgccaccatgcccggctaatttttgcatttttagtaggaacagggtttcaccatgttggccaggctggtcttgaactcctgacctcagatgatctgcctgcctcggcctcctaaagtgctgggttttcaggtgtaagccagcacgcctggcctccacttactctttacctctgagtttcccctctaatcataaactttttcggcagttaatgagccaatccattgtttcagccattgcctttcaggacatgaaagggtatgcagtaaaacgtaaggactactgctctttcacttcttccattttattattaatgagtctagcgcattttcctgaaataaaagctatcagtcctgtttaaatattcagtgggcacatcagttctcctgaagatacatactattcttttcaaagaagttagagagtttatagaaaagatcatgagccacagatggaatagctcttgaaagccaagattcaaaatctgccccatttttggcagagtagagctacatatgttgtgagaaggtgacactcctgtgggggacaggaagatgatttctctatacatgaaaactgcttgtaacctggccaaagaaaatgtgattgcactatgtacagcaaatctttgccaaattcagaaacccctgactgggcagctttaccatgaaaacctcgagaaatccttgatgaattcttcgtctagtgttttaaccagaaatccagcatgttttagaaaacagatttttttagaggaaagttttttcacatttcactttttttaggagacttttaataaaagtaactacacaccaattgtgcaccatctaataaaatatgtggctgtagttatggcttcagccattgggcagtaatgcattttaggagttttataaacattttttctcctgtctgcattccattactagctagaaagtttgaatttccttaaatatgttcagcagacacaggattgtcacccatgaattcagagttataatgcggatgttgagtgggtggtttcactctagaacatcccaaggcctccaggtttctggcactgggagaaactataaattctttatatagaagatgtcttagatgccacatatttcagatacctacactgaaaaatcaggttgcctgcttgggagattcaagcagataacatatttttcagagatttagaggctgctgcatttagtttagcatttatcaaaacagatagtagttcacccctaaaactgaggagaaaacacaacaaaattggaacttctattaagaacaatatggttcatgtttatctagaaaggggaagaatttgttttaattacctctgattttgaattactacttaattacaacatgatgatgctcaatttgacaactaaaattctaagaaaaagctttcacctgattaagatagggaaattatatgaaatgttccaagggatttttttaaaactctagttttagactgtgaatattgtataagagagtgcgaagcattctaagaaggaaatatatcagttttgtgtcactgattagacagattatgccatctacatttctttcactgaaagaataaattctttccatagaagatgtcttggatgccatttattgcaaatacgggaaaatgacgtagcttgttggggagattcaaggtgtttcttgggagcttagggattgttagagcaaacagaaaagagaataaaaactaaaaaattaataataattcagtatagtgactaactcaagcaagatgaggagaaatagtgaaggttaagttaaaaaaaggaaaaaatgatgcattgcctagaaagttcatttgctccttataagagtagtttatgcatttttagtttttattatataataggctatacttcacatgtatcaccaaagttgaattgaactatctggcactatgtatcattctgaacataaatatttaaagataaatatagacattaatgtgtagtgcaagattagaaaataaggtactatcctggccgggtacggtggctcacatctgtaatctcagcagtttgggaggccgaggtgggtggatcacttgaggtcaggagttcaagaccagcctggccaacaaggtgaaactccatctctacaaaaataccaaaattagctgggcgtggtggtgggcgcctgtaatcccagctattcaggaggctgaggcaggagaatggcttgaacccgggaggtggaggttgcagagagccgagattctaccactgcactccagcctgggcagcagagtgagactctgtctctaaataaataaataaataggtactatctgaaacttagtttttaggaatatctattttcaccctcaataataaaatgtcaattgaaaggtagtttattaaccatggttgcatattagttcaaacaaccttgggtttaaatcttgacttttcaatgaaagatttcaaatgagtagcaatgtgaatatggataaaccacataatctttctaagccccattgagaaaacaggcctaatttaccttactctatattattaaatgaaaaaaatgcccagaaacaattctaggatgtataattgatttaaacacaaaggcctatctgggtttgaagttgggagaaaatgaggaatcagattagcaaatactttgtgcaaaatatccaggtgagttcagggaaacaaatcaatggacctttttgcccagggcccccctgtgactcatatgtgctccatggtcactgatccaaacacccccgaatgaggtctctgccaggcttaggaacccagggttgtatgccagccaacttttacaccattagattgcgagaggagccagaatgatactcaagagtctactatctaccaaataaatgatatattcccacatcttatttctttctgtctatgtcttactaccctcacagtaaatgctaaacttgcctgctaactgctttcattccattatatatttcttagcttttgttccattggaaaagttaatgtccagaaaatattaaaacatggaataaagttaagactaatcatagatagtctcaattgattagcagtctcatcaaatggctaaattctattcctatgtgacattccactaaaatattcaggaagtagaatagcaaggtgaataatatcattatttttgcacgtttgacctattataatgacttttagttacagtattgtataagagatacccagttttttgttttgttttgttttttgagatggagttttccctcttgttgcccaggctggagtgcaatctcagctcactgcaacctctgcctcccaggttcaagcaattctcctgcctcagcctcccaagtagctgatattacaggcatgtgccaccacgcccagctagttttttgtacttagtagagacagggtttcaccatgttggccaggttggtctcgaactcctgacctcagatgatccacccaccttggcctcccaaagtgctggggttacaggcgtgagccactgcgcctggccgatgcctagattcttttaacagctctgtggctgccaggctggctcacctttaatctcttagctcttaattacatctcttgtcagccagaatgacatttccaaaatgctaactttaccatataattcgtgttagtaatacattttcagagaggctttttatgcctcagaatgaatttcaggcttataacttccattttgatctgcccgttgcttgactgtccagccttctctctcacactttcttctgtttgttctacttcaagttatcttccttcagcattgcacatgtgctatatttgtgcaactttccttttcaaaattttcccatgtgggtccagtctctgaagactgaattccaacatccctgccagccctgatcttgctgcctcatggatgacctcactgtgcaatttcctcagcagcatctctaacatctttctactggttaatcggccataatatccagatatacttcgatggtacctgtgtggactgtttttactatctctacacaggcttcccagaagagatcactcacaacaacctagccgatttctgccaacatgattacttcatcctcggtgcatcccttatttactggtattaatctgagagcggcttcctgcaccttctgagaataaaacagataacaagaaaagtacttattgaaaatatcaaggtttttgaagttacctgtcacaaatatgtaatgcctcttcgttcctctgtatgtctgtagcgggaagaatggggtattttaggaaatattttctctatcctaacctatctcaccttcattatggccacagtgtcctagctcctgcttccttgtttttttgcccattaccaaccctgcaatatgaacatataatctctggcacattctaattggattttgtcactcccactgcttcagctgttttagtgcgttccatgctttcactttcagttttaagaattttcatggccaggcgcggtggctgttgcctgtaatcccaggacttttgggaggccgagacagggggatcatgaggtcaagagattgagaccttcctggccaacatggcgaaaccctgtctctactaaaaatacaaaaattagccaggcatggtggcactcgcctgtgtcccagctactgaggaggctgaggcgggagaatcacttgaacctgggaggcagaggctgcattgcactccagcctgggcgacagagtgagactctgtctcaaaaaaaaaaaaaaaaaaagaattttcataaacattatatttgatgtttagaagacgtaaaacagaataaaagcataaaaaatccagttaagatccaaataaaattcagataaaacaaaagtaaaatgccaatgattacctcacaactagccagatagatggctcattttatttattcattaattcagaaatgtttattactgcatcaggcatggagcgagcaaatgatgtgcaatgggtggtgaacaaagcaggcaggatccctgcttttattcttctcaatcaatgggctgctttgccttgccatagtctgatcaaatccactgactaaatctctgtgaaaaccataccttccttgctttagtatagaattttattttgcttgtcagtaatctgaattaatttttcttgatacgagaggccaacagacttatttctgacccttggtcctgtcattttctcctgtgcatttctaggaattgccccttccatcattctcctgctcagtgcgcatttgctgatcctcccaggtcagtcacaaggggaaggataagggtatcttaggaatgtttcctacacaccttcttattgtaaatagatttattctgtcccacaaacaccttaatatgaggccagtctatctgtcaatcacaatttattatcagtaatttcaaataggatactgctcctatttttatcctccagtaaatagcattttgaaattggaaagagaatgaatcccgagaacatgccactttgaaagaggctttggttagagtaaaagcctcaggaaaggctgaagtcctagggggttaggaggatgaagagcaatgtgagagaagaatgtcgcatgcttgcaagagtgtatcactgacaaagagctctgtcgcatcctatgttaccagtgtttcatccagaaatgtcacaaatagatcacagaagaaggagcttgagactaccccaattttcacattatccctttttagactgggaaaccttccttcctgtcattctgctgagttttgagcctcaggtcttcctaactggcttctatccactccctctggaggaaagaggaaaaaaaaattaaaaggaaaggcagagacatcacactgaacactctagtctcactttccacattctcttgggttcagcatccatcttccttgtctctatttattacaatcatccatgggcttccatactttttctacctacattttttacaccaaaatacaaagagagacagagagagaaagatactcattacagagtaaaaaccttaatcatctagtatttagaaatcaaatggaagcagggcaagtccaatcaatataaagtaacatgcttaaaacccaaagcatttaaaatttcctctggacccccttggtcaataattcaccttaggtcttggccagggccattggaataaatcagcatactaaaagccttttatgattatttaattaaccaatccctttcaatttgtgtaatcttcattttgaaaaacctcatccaatgatgttttggtggtgattccttctacccttataaatatccaacatcagtttacataagtttcccagcctaatgttgacaggctgcagtgcatattaaaaaacagttgaatggtttttcagaagaacaattttctatatgtgaggcttcttaattactaaaatcacattgacctgtcatggagtaagatcggcatatgccattcaggattcagtggagaaaaatctctattcttatatactcaaagccttaaacgatcacatgcttagctctgaaattatttccagaattcactgttgcatctttacagtaaaaacagaaaataagaaaacctaattggcatagattggttgaaattgaaaaagaaataaaatctcaacattcaaacttaaagaaatatctcaatcagagctaaaaaaggatgattctcaagataaatattgattttctatttatcaaactctttaaaaataataagaataatgctaaataatactactttgatacaaaatgacatgtatatattagcacacttgtgagagaaagtaatgaaattttatttgtattctttagtaaataacagaagcacaattatatgttaacaatttgaatggggagagaaaaggattggctatcactgtacataaaacctgtatacctcagagtcctgcacagtttccatagaaacacagcaatagctagtgtagaagctataggcatctccagacaaaaggcttgcccgagctctcatttcagtatatgcaaagtcttaagaacaaagactgtttttaaaaatagaaaggaaaattttcaatacacaaattgtcaaaccaaaatgatataccatttcataaatattaaaaaatacatccttccaaataaattaaatggaagagtaaataaaattctatttcattaatcaacatatcaaattcataaaacccagttctatcaagtttttttacccaagacagcttgagattcatcaggaaaattcaaaatcccagttctctagtgtccattaaggtcaatcaagtttcatagaccactgttctgttaatattgctgtttttaccttagatgtttgttcagtaaaagtatgaagtgtctatcaagtccagtgatactttaatgtgtatcaagtccagtggaaggaaatttgtatttgaatttattttttgtttctttcttccgaaccaaaggtctctaaaatgctcagtaattaactcttggattaataacatcatatctaatgtaactcatcctgctaattatttaaaaacattaataagcatattaatcttatttgtataaaatctaaatccttcaaatactgtaagtcattagattcctctcccctctaatctttaatactaacgttgaagtatgaggatattaatttaactcagtaaaataataaaacaatcaaactcacctctgttttacaaaaaacttccaatattttattttggcatagaatccaacaatacatacattcttaagagaaactaaaaacaatcagccactgagtttattagataaaataagtcatgaatttcacaaatattttattcaatgaagagtcttgtatataatggtaagatccttgtcacaattgaacaacagagcaaagaatacatgttaatgtcaacattacatcattaaactacaattaatcagttaaaaactcagtcatggctgtctaatgaaggacatttttcctgggaaagcttaacaaatcactataaaaacttatgcaaaacagttattttctatctctcagttcataatactgatgctatataaaaaaattcttaaacattttgtgtgtccattcattgtttttaaagaatttccataaaataatttttgtttctaaataaaccagacgatcccaaaattttgaccaaaatattagtcaatatggatgtacaataatatcaggatataaggtgaacagatgtatgtagtgctaacatttttatttttagcgtgtaaagtctaccatggcttagaaggttcacaaccatatcagtgtaaatttaggcagaaatctttggaagtatttagaattgctctagaacactgcaaggctatatagaagaagcatctccaaaatgtttgcagttgagagcaatatctccgtatcaaataaacaattttaacctaataaaatttcagaaaattaaaaaatctagactcagtccggtataaaacacagatctgatgaagatcccagatattttgtagtgctgaaagacgcaaatgggaaaggacaaagtgttttctctgttttgaagatataaaaagaacgtttctatagtggtgtttctccaaagtcatgcccaacaaaatggatgtgaggaatgttgtttagcatatatattcagaatttcactaaaaaccctagatttttccattaactcaaatgttgtttcattctgctaataatttttaatccttacctatccactattagttattttgcatttcaaaatcaagtaaaaaaaaatggcaaatttgatggagcagaagggaaaaatggcagcttccttccaaatgccttgctttcatattcccttaaaggactacctattaattgtcaaaaccattaaaaggaagaaatcaggaaaatttctggtggtataaacaagtccacaaattaatataaagcaagtcatataaatatactccaaaaatagtctactcttttcagataagccaattaaatgtttattacagcagagccatttttctctaccaccttgaatcaacatgctgcggaaatccaagttataatctataaatcagcccaatggaatgaaagcacaaaaggggaggttatattttattctgtgttgactagaatatgaaacaggaaaccttgagaaaaaaaataaaaatttcaaaagacactaaattctggaaaaccttcgattataaaaagccaaggacacaatatacctgacatcactattaatttgtggtgtgagaatttccataaaaattgcaagaacttgaaaccagatttttttaaagggacaataaaagagataacacatcgatgagcaaagactttttcaaaaagagatctatggcaagacccttaataaaactttcttagagaaaaatttcaattcaatattatactgagtctatcctaaatgtctcccatttttaactgacttaccccctgtgttaagtcaatttatatgtaaattctatggaaaattaggttaatgtgcctttttcatgtaactgacagtaagagcaaatgcatcttgccacttggcttccaaacaaaggcctggccacaaccttgacgtgaggaacggaatcaggaaggagggacagaagctcacactgaaagagcaaactgtgctgattcatgatgtcaaaactcgagctgctgccaaaaaagtcaggtgtgcaagggatctctgagcatattttaacttgttcagtctctaatatattcaaccattgatcttggaagcatgacaagggttagcaacaacgaagaagctgccccgggaaatcagtttcatgaacaggcaaagtaagaatccctacttaaataatatttagtttcatacgtttttcctagcgacgttttaatgtccctactaaatgttattattcaatttcacacttacacattatttatcgaacccccaccatgatttttgaaacaccctgttacactttaatatatacaaaggaagaggtatataaaataagtggagttcctgggaacaaagggaaaataaattcatatacattgaaatgacgaaaccaatagtgaggtaagtctccaaatctcatagtgtcaaggcctacgtatgcaaatcaaagtccaacagcaagccctgtataaagaaaatacaatctttgcaaaaagcaaagaaacaaacattttatacacacatgggtgtgtgcacgtattttaataacagacatttataaattccaaatttaattttagaccattgaaataattattaaggatgcatgtgtaaaggaagattgtagtagggaagatagtaaatgcaagatagtgaggtatactgttgttatgcaaacgtacataggctttggaggagaataatttggtgttttgaatcccagttctggcaataactagctataggaccattgtgagcaaggtcctgacatattaactagagataataaagatcataggttttatttactgtcttcatgaaaaatagcactcagcctttcagaaccttggcacacctgtttattattatctatttattattattataatacagagtagacagtaaaaaaattacatatcttagtccttatcctattgtaaggtactcaacaaatggtagaatatttttaatattaatttatactaaacatgcagttatctcttcatataacatgtaattgtgagatagagaacattctcttctttattaacttagtaaaaaaaagataaaaatattctctacaagagtccacaaatgaatgtgttatatctacttataagatatgggattagcctttatattttataattagtaatgcagttgatttttaactagaaaatatcaaaacacaccaaatcctaaacataattaatttactaacaggatattaaattagcataaatgaatttgagaaactataattttcaaacttctcttcaatgttattagaaatcaacaatgtgcccaatatgttatctataggttatgaagaccataggaatttattcaattgtaaaaaataactaataaaaaatttttttaatccctcagattatatgataggaattatttttctttgataacatttacatatcaaaccataaagaacagtttgacatttaaagtaatgtttttaattagtccacttgctattcatagagcagaaactctgcaaactacttttttagaatttatcactcatttatttcacagcataatggagcacagatttgcatgtaatctgcttacctttcaccatttcccaactccgactctctacaatgcttattaaaaaataccagagtagaacttgaagaccactaggttgggcccaccagaattctgttttcttatgggattaatgttttctgtgggaaaaattatcctaaggaaggctgaagcatttagatttaggctacaaatattagactgatattaatagagttgggtactactatttaaaattcaagtttggtttctgtcactggcattcatctaatagcccaggtccatgatgacaaagaaaactctgtagggggcctaggtgcggtggctcatgcctcccactttgggaggctgaggcaggcagatcacaaggtcaagagattgaaaccatcctggccaacaaggtgaagccccgtctctactaaaaatacaaaaattagctgggcgtggtggcgtgcacctgtagtcccagctacttgggaggctgaggcaggagaatcgcttgaacctgggaggtggaggttgcagtgaggggagatcgcagcactgcactccagcctggcaacagagcaagactctgtatccaacaaaaaaaaaaaaaaaaaaaaaaagaaaaagaaaaagaaaactctgtaggatagaagaaaactcaaacaacatagttttttccttattaaagatgcctcaaatttttctactgcctatgacatagatgactataattacctaatgactttatctccttaataacatgtatatctactaaatatataaaataacattattatatacaataaaacattacatattatgtaattgtaatatatggatatatcaataatataatcacatattgatagcttgtgaattactatataattatacatataagtataatacataagtatatatatcaattatacagttggaataaaatttactaattttttacaaatttattgtataacatttgttggtaattgaggtaaaatatgtattacaaaatgatattccagaaaaaaaagaataattgctagtaagctatccagttcccagaaatgcttatggaaatgatgagagagtggctccatgctttctttattctgcctcacccactcttgttctttatctatcctgtgagcactgcagtttctcaccatagtgcctgtttaaatctcaccctgcttgatgcaatcgttacccatttgatgtggaagtctttatgaatatcatctgaccaataaaaatattttaaaactctcatgcacgcctagagcaatttccgttttgtttcagctttataatgtatactagacatcctcctcaatcaacgcagatttacgtcattcttttccaaagcacgttatatttcacagaagaacttaggctatattgtcaatattgaatattgagtgtaatgaatagcattcatgtggtttccagttcagtaagcgggtttcgtatggggcaacatgaacatgtgtttgccttcttggtactgttctaccacagcttttcaggtctcatggctctcaagaatatgttctactatcaccaagcaaaattagggacagtctgctccacgcatccctagaggcaaacactgaaggtcagttaacaaattaaaaataataataacaaaaaacttttctatgaagcacaataaaaattaacatatctgcacttagtttttccctttggcaacagatacacccacctgttggtagcgtgattgttagctaaaaggttagcactacatatatcctgagtaaggaaatatgagggtaaaattttaaaaggagataagagaataataactataagttcaaaattaatgtgctttatgaaaagaatgactttgtccagagaagataatacacatgtattcattttgaaaagggtaatataactataataatttacagtaactcggaggtagcagtatgctcagtgaaaaaaaaatagtttaaagtcagaaaaaattagtattttaattcatgtgttaacttttttttttttttgaaatggagtcttgctctgttgcccaggctggagtgaagtggcgtggcgtgatctcggctcactgcaacctccgcctcccaggttcaagggattctcttgcctcagcctcccaagtagctgggattacatgtgcctgcccccacgcccagctgatttttgtatttttagtacagatggggtttttccatattggccaggctggtctggaactcctgacctcaggtgatccacctgcctcggcctctcaaagtgctgggattacaggcatgagccactatgccaggcccaggcatcaacttttaataaatcacttgcatgaacttctgatttcttgctctgcaaaaggaagtgcatctgtacaagagcacagttttctgtctcttctgttcatcccaagtgcttggcacagagtagacactcaataaatatctgtggaattcatgaacggctatcatgcagttatggagagacttaaatagcataacacagtgcgtcacattcaacacatgcatattcaaacctatatttacctattttatagttttcgcttaatgatttcatgtgtctcaataaccatgtaacttattttaaaatgtatcttaatgtttatgacaatttgaatttccactacacaaattagccagtgttttctgaataatacctaaaatatctggacactacagtgctttagagaagcaagaaaactaatttaacaatcagtccccagtgtgttctctatctccaaaataagtgaatttgtgatcacccatctataataatattatattttattggatgaatatagaaacttcctaatggtaggattaagccaaatcctgaattctgtctactcagattagtcaggttaaatgataaaaggtgtagaaaagataaacttgtggtggaggaatttaggagccttagaaagtatatgatccatcaattagaagggcaaggtatcaggagaggcaggaaatgaaatacatagttcatcaccaacaagaccaaataactcagagatgaataaaagcagcctataaatgcagcaaagggcctcaggcacagtaataaaaaaaaaatagaacaaaaaagataacgttcacattaatttctttggttttaataacacgactcaaacaacacccaccgtgcgaaaataagatcatacaagcacacaaatgcttctatcagaggcccaagcggactgaggaatcccaggtggtctgtttggatgccctgaagaaatgaagggaagggggtgtcagggaggggcgcccagagctcttctgttgtagcattgaccaaaaaagaggcagccagagaaggaaacagatttcatgtatcattaatgacatccctacttctggatctgaaattccctctcaacttcaaccatgtcaagcttcctaaaaccccttcctttttgaacttctacttcacagcaccaagtgatcttccatacagttctctgatacttttgctcttttccttcctttgccttctaactatgggcattcacttcattcggtcattacctcaatgctttctttttgcctctgatttcctgcacttgaaacctttaactagtgtctctatgcagattattcacattttaaaagttcacaatcttgatcattcatttgagatttatttcacatttctaaaggctgtggaactttgggtgtgctatataacatggccattgggatgactctcctgtgccaatgtcctgtgcaaatgtcctgtctaaaagtttacctttgaatgtatactcatgagaccttcattataatattcagttaccacaaatatttcctccagtatacatttctggatccctttttaaagcgtggttttataatataacacattttcataaagattcaaaggtcatctagcacagtgatcatgagcagaaagggtgagtcctaaaatatcttgaaacctcaggtttctcaaccataaaatgtaaaaataataatggtgtctatctcattggattcttgcaagactgaatcatggtaaggctctgtaagtgctggctataataatcacagcattgttattattatcagttttctgctaaactctaaaaagtttaggctaaaattttcccattatctaaccccaattttatttcacagaccattcttccatatactctaggataaacaaggagaatatctctgtgtttctcaacgatttttttccctcacccacctaggcttttgctggggctatttttcattatggaatatcacgtcatctactttcacccttcaaaatcttaatcatccttgaaggttcctacaaaaaagtcacccttatgcagaatctctctaaaatctcaactgaaagaatacaaaggaaattatacccagccctgtaaggtaaaggtgctatgtcatgtcttcctccccttacatatctctaatatgtttttcaaagatggaaataatactttgttcatcattgttttcttgatggtcctttttaatacaatgcggcaaattaataaaactcaaatgcagctatactctccagtttatgtcagtttattacatccgattaactagtagaaacacaagtcatggaaattacagataagttgttactaccttatacatttaaactacttacattccataagtagtataaattaccttatttattggacatagcttaagaaatagaacttattaataaataaatgtcaaaattaagtagtgaaaataattattctcatttctttctttaatacacgatgttaccgtttgaactactaaaatactctttatataccatcattttaaaataaatatttaagattttgttgtcaatacactgagtaaaattaacacagacatggtaatatccatatctgtactagaaatctgaaaaaaaatttattgttgtaagttattagcaatgatggagcaaaactcataaagtaatgctattaaattattttcaaaatgttctagtttaatgacagtttatttaatttgcttgtgaccttgttttatttatcaaaatgagaaatgttttgaattaacttttttaaaaaagtaatttaaaaaattttttgcctttgtcataatagtaaggattctaaacataaacataaattattaaataatcaggcactgccttgtcaccctattttcatctacataagaaacttaactctaatagaatttgtttcctattaagtcacattaattttgccaataatttttttaaaaataatggataaaggaatagaacaattgtgaattattcatgatgttatatttttctccattttcatcagaaattcttttaatccttttgacttcaatatttcataaattaaattagtgaggaaattcagtatttgtggaataccaagttaaataatatgaaaggagcttaacatacaacttaaaacaatgcaaaattttcaaagcataatattaaagcctattatttatttgtgccaaattatatgctttgatataattaaataaaatgaatgcatactttgattcaattccttaaggcagagctagtaaatggaataaatgaattgtctcatttaaatgttttatactttaattgggaaatggattgtatttgaatttatatagattgataagaattattggcaatattttatggatttcaattttgtcacattatatcacaatatttacagacaaaaaaatagaaaaataaattttgcaacaaaaacttcaaatcagaggagaaaaataaagactcaaattcattttatgagaatcattctatttgcatagcctcagagtatctctctgaaatatctaccaattacaatggtagtattaacatatgtccacaaattttttgatatcccttcttctaggaagtggagcttatcacctctctttaaaagtatagtatagacagaatgtctcacttttttaacatacatagtttgaaacgggaaaaatagtaacttcaaagtgaagtaacctagtagaaaacaccttagccaagtgatcaatattaatattcccagtaataaataaggtggataatatgtgcttctggatatgaagtgatgagagaggcacatcacttttgtcctagtcttcccccaaatctataatcccattctaatcatgagagaatatcagacaaacacaaaatgagggcaattctacaaaatacatgactagtattcttcaaaagtgtcaggtcatgtaaaacaaagaaatatggaaacactgtcacagcttgtaggaaactaacgcaacaatagtttcttggattgtatcctagaacattaagtgacattagcagataattagtaggtaacattagcaaatccaagtaaagtctgtagttaattggagattattatatctatgttaatgtattaattttgattaatgtatgatggttatgtaaacattcagaggaagctggtttaagtgtataatccaagtttctgtactatctttgcaatgcttttgtaaatgtaaaattatttcaaaattaaacaattgaaggagaaattcatctcatgagtaaataaaataatgaatgtgaattataatgaactcgtcaaaaacaaattatgatgattatagtcaatatcatcattagcatcatgacctctaaatatgctaagtgtgtgtgtgtatgtgtgtgtgtgtgtttgtgtaatcatatatgagaatgaacagtattgctagaggctgaggcaatacttggttgtgattaaagacacaaactcttgggagcaaattctctaagtactagtactggccattgcacttatccactatcaaattaagttaatagcctctgtataaatcaattgcctcaatcctagtaagaaaagtaatagtacctacatttggtaatagtcaaagatctcaattcatcccctttctgtatgtgcatgctgcctattacatggaaacatagaatctaattccccctccttgaagctgggctagcttgagtgacttggctttgcaagtacaatgtaacagaagtgaatttctcccatttccgaagctagatcataagaaaccttgcgactgttgccttaatctctaagatcacttgctctggggatgtcccctgaccaagtccaatcgccatgctatgaaaagttcaaattccacgcagaggccacacctgggaattctggcgcggagtctcagctaagctcacagccatcacccagcatcaattgagccctcttagacattccagcccaatcaagctctgaggagactgcagatgtcccagcatcttgcagccagcatcacatagaacagaagaatgaatcagacaacccacataactgtgaaaaataataaattaatgtcttaagctactaactttgtggtattttgttatgcatcatgcctcctacagctgttgggagaatagaattagtaaccacattatattaacattaactattgttatagttattattctcatctcctctaaatcacccttaacagttacccaaactgattattcttttaaaccctttcccctcttaggcagaactaaagaagaaaccccttttttagcatttgcattcatactactcatatgttgtcaacagatttcacatagatcattagaataattctactaaaagacatatgccagaaaataatctagggtttgaaaaatagatgcagataaatcagcactgtatataaagacaaataagattactcccctcataactgggattaattcaacagctagttacagaacacgtgccacaagccaatcaccatggctgggcaaggcggattcaatgaggaacaagatggaaatggttctttccttgtgtagtttgcagactcagtccaatcagaaagacagataattacagaagcaattataatagagtgccataaacacttcgatagagaaaaaagaaaaaaaaatatgagagagcatcgcataaacctatagtttccaagctgtgacccaaggcatctcacagagtggcagcaaactcacaggatattgctggatattttaaactttcaacagaaaacacagtgacatccattaacttaaaagtgctaggtgtttcttttgacttggagacaccatgaggagaaattactgggacactacaaacaccatgaattgagaatgtttaaaatctcaggtagagacacttacaaataacaccatcttttttgaaggtcaggaaaggttttttgttttgtttttttttttttgaaaaatgaatagcagtattcagttggcaggtagcatttgatccaaattacccttcttctctcccttttcctgactctcctccctccaattacatcaatttgggcatctacaaagctcccgtgctgaacctttgccctctctacttatttcagtccctcacttctgattgtctattttcatccccatatggtgtcttaatgtcacttcaaactcaaaatgtctaaaataagacattttttcctttacccagcaccttctcctgccattcctgtttctctattctctttatcactcaagcacatgaaagcagcttgagtctagacgttcccttctccctcagaactaatatgatatgtgtgccttatcagttcttcttgtccatgttcccttgagtcagttgcaccctttcattctatggcttttcccttggtctggcctctatcatcatccacctccagtctcactctctaatccattctgcacaaaacctccagactaatttcaccacaattctttctccaacagaagtgtaaaaccgagcacacacaaaatgagacttacccaaactttctttctttgagttcgaggaacaaggctaaactttattctttaaagagaaagaaaaatatctgtggtcttctttgaaagtgtttattaacctttccagccacttgctggacggcattccctcccccaattgacctccctctgtgaattttcctttagcctataatctcggtgtttgtttgttttcctttgtttttctatttctccctctgttcttttttttgttgttgtttttgttttttacccttgatacatatgactgttcaaatccttatgaaagatcaaacaacacaaaaaactagcatccttttcattggatgtgacatgccaattaataaaattcatcttaaagctttaataatgtatttaatgaggcatgcactacagagataaagcagaaatgatttcctcaatagtttcactgataatactcccaccaaagtcacccttgaccttaccttccaggtctgtcataaaagtgtgatgctgccggccgctggctccttgtgaactctattttcccttgattcaagggcataagctctctcctgtgacaatttaacattctgtttcgtgttctgagattttttctaaattgtttttttaagtcactatttttggtcctttttgttccacctttaggttgatttcatcagtatcaacatcaccaatgattacatacttgttgatgatttacaagtacagatttctaattcagcttttttccccaaatcacaacccatgtatctaattgctttactgacataactcttcctagtcagacaaatttaatatatgcaagacataattttctttgaaaaatctgttccttttgctctcacttctgaaacaagaatattcacaagcaatataaagcaccattttaaaatgacagctttaccttacagaatataggctccatgaaggctggttttggcttgttagcttgtttttaattgctatcttcccagcaatttgactacagctggcccacactgggtgcttgttatatatttattaaatgttgaatgaatgaacaaatcaatctcatgaagacgaaaaaagtcatacatatatactttgaagttttaagttatgaaaattacacttttccattgtttcatcttttcttccccattttttccatctacactcttctcatcctttatttcagatttgattttgctagcacctcgcttctccacctcaccctgctcctccagcctctttttgtccctttgtggatattcattaatatgtgttagtctagtcaaggcaaatggaaaggggagagagaggatgtgtctgaatagggaagagcaagacagagaagagaccaaacaacagaaaggaaaaggagaaacgtctgaaaatagatttaaagaataaacaaaggaggatgaaagcaaagatttttaactgatatgtcaagaaaaacaaaaggaacagtaagagatacatgtattttcaatcctgaaatcaaggaaaacagtcagttgtttctcaaagaaatttctttaaattggcaaggtatattcagtctgttttattaatagaaataaaagtagaaatatacagactactgattttttttaaataacagttttgaatcccaatacttgaaaagctttaatcaaagcaatcaaagcatcatacagatgcaaatacaacacagacaaaacccttatccccaaacctagaaaatttaatgtaagagacagttataaactaaactgaaactagattttattactgttaattatttgcatagcagaaaatgaaaattttacagaatcatgcatctatagtgttacaggggaatttcagaagtggattttgtttcggaagtaaattttaaaataccagccaatgatgggcaaatacttaaacctatccaccctttaatagttcttaatgaacaaatcagacatataaatagaatgaagacattaataaggctatctaaaaatttaagcaaacaaaaactggttcataatgtaataaattagagccatagctccatacaaggaattatgataaagaaagaaaatgaggaatatgaaaatgaaacactgctggtttcatttacactaaatgaacatctcctggaagtaggaagttaacgtgttttgaccacagtgtacttggtagtgggattagaagacaccatggtgctgtaaaaagagtctgcatttgaatgaggccagcagggttttaggcccagttctatcactaattagttcctaatcttacaaagttaatttacttttgcagaacaaagatgatatttaatacgtcttctttttaaaagtgctataatgaataatgatttttaaaatttatttcaacaatagacttttggaataaatgtgttctatttaaaatatttatttttatagttgatatccatattcagcttcttgattaatcaaaacatccatgtttgaattttaatatcagcacactaataagaaataataaaattaaaacatgtccccttcattgatctcacatgttgattgtcttggcaactaaactcattgcagaagctgtaaatccattatgttcaatttatcttgtttttattattttattatcctgataaaagcaggctgactttaaaaaataatacttcctagaaagtcaattccttctcctaggctaaatgtcttctgaggtatgagaaatcagggaacatgaataacaaaaaaaacatgaattgtgtcctaggacatgataacttgctttaattttctatctccaaattttgtctttatgttaacagttatctaccggccaaaggaagggagttaaaatatagaagaaaaaagatattagtgagtgataccatcaaaccaactctctatttctctccttaatgatttgtcgttttaccatcttcctgctccctaaatttggctatggcagaactggccagcaaaggctgttcctgtgtgccaatgtgcctttgtatgccatctgcggatatcatctgccaggcacctcacaaaatcatttacaaggagaaagagctaaatagaaattgccattgatagcaaatatatttgttctgagtaatatcagaattatctctaataacatccttaatactgtaaggctgtttcaaccttttcttattgaaatacacatcaaatcaaaaccgtatttcgtaatcatctaagtgaatttttaaatatctagctttttacacatacatttatcttgttagcactacataaataaatgtgtaatagcacattcaaggcaattcttagaaatttctgcccaatttgccattatctacacagttttttattccccatctagttaacagcttctgagaagcccaggttcccaatttctgagcatgtttaatcgaccactatggttgtcatgccaaccaacacagagaattctgagcttacatggggcatttcaatacagtgacccaattactttctgtcaacaaattcaccagcaaaataaaggggctaacacattaatgagatttcctgagactgccctgtagagatgcttgcagtaagatcaccatcagtttttaaaatactaaaatgctattaagtatcacaagtatgattctttttatcctctgccttagttactgttatctttatgagtgtattttctatcaaaaatgcctgaagtcaatatattttagcttctctttcactacaaaatcaaatgacaccggggtgtacatgatataaggataccatattctccaaaatggaagtcactctatctcaacacgattttaattttatattgtacaatggaaatttatgaaggcatagggaaagttgtatatccttttcgttattgttttaaaaagtcttcatttgaaaaccaagaacggcaaatgccatgaattaaaggactttgcaacatgatgaaattatctattcattgcctaaaaaatattttgttcgttcttttagggaggaaaaaaagagagcataaatgttagcactaggttgaaacaaatatttaaactaatcctttagatatataacatacaaaatgttttagcttcacttgggtatttactatatttacaattaaagtttgctttaatggggagtggttgtgtgtatgagagagagagaataaagaaaaaaagaaataataaatacaatatgaatgtacctattttctggccaatccttttcctatgtcttttggactagagttccatttttttcacaatttataatcatgttatgcataggctctatctattaggtaaaataaaattgattctcagatgagtttatttaataaataaatcagatggcagatgggctttattaaaacaagtagagataaataaaatgtatagatagaaaagatattcttgttctagcaagatgacaagaatttaataatgtttttacattactcttgaagatatcagttttaagaaatgcatctaaaattagtagaagcatagacatggaactctagcaccactccttagcattgcaaataggaaaattaaggtctcagaggttaagtgacttgccatatgccacccagtcaactggtggcagtcacacaatttggagcttgcttcattatttgacattaatttgtagactgttggatgtattgttataaatgtccctatatgtaaagtaagagcaatttataaaaggttaaatttgcatatttaaaattgaactcagaaattgactgcagtcatcatcttcatccacataacagagaagagattcaattttctcttacttaatagatggagactactaacaaaatgattgtatcagaatgaaagcactcatctaaaacatacagaagcaatatttattacaaaatagagacattcatattttacccatttattcacacacacacgcacacacagacacacacttttctgtaacatgagcaaactagtttccaaatattttgtggcttttatgccttctgaaaattgacatattgtccttctacactcccagaaatacttccatttattaaaatatttatggggagcctattttttaaatcaaattgatgctttgataccacaacctgtggtcatatttagttattaatcatataacctgagcagtcctcataagccctaaacagtcatcagtaaaattagcattgacataaaagaatttataaagctacaaataaatgattgtatttgtttacagtataacagttattgactctggtttaagtaatttgatctcattataaaaatatatttcagtctctttaatttccaactcatatgtgctaaaaaattttaagctcatatgtttaatccctctgtttactgctagtaacatatcgtgtttatttcttctggttatgcattggattgaaactgccatgccaataaaaagttaagtcaaatgtgtagaaagtattaagctcacagcatgggttataccatttttattttattctaaagttttacagtggatatttggtgtctactcttccaagtacttttaaaagtaaaaaataaaactagaaaataattaaatgaagaaaatagccaaaaagaagaggcaaccctatattttttttactgccctggtaatacatttatttttaatggacttgggaaatgcatgctttcttgtaaagatactctataaaattgagaatggcgttatttttcaaaataacaactaagtttacttagaatacatccactgataattataattgatgaatattagtaaaatttgagatgttaaattccattttgcttaataagtttatattttaaaatacaatgtaaaactctttattttggaatttaacttataattctttgacatctgatcagaaagtttatttgccaatttccaaggaaatattgaaattaaagacagaaatacatatgggattctcatgttattgtattcataatgcttttacttttaaatatttatattaagaaacctttcaaacataaaacaaataatataacaagcaatgataaagttgacaatgtggccgaccatggtgacgcatgcctgtaatcccagcactttaggaggctgaggcgggcagatcacttaaggccaggagtttcagaccaccctggccaacatggtgaaaccccatttctataaacaatacaaaaatcagccaggcatggtggtctgtgcttgtggtcccaggtttttcatttaccattgtatcttaaaaagttatccatgctaatacattctttagctagtacagatgagcctactattatggactatattatgtatttttgatagaactcctccaaaaaattaataataactgcccttctgaaagatgttctatggcttcatacaatatgaatgctcttactctgagctatccaggaccctgttggtggaggttgcctggatacccaccgtccctacctcacagcaattaagaacattctggaatagtctgtaagagatccatgtattctattctattctatttatttatttatttatttatttatttagagatggtgtttcgctctgtccctcaggctggagtgcagtggcgcgatctcggctcactgcaacctctgcctcccaggttcaagtgattctcctgcctcggcctcctgagtagctgggaatataggcatgcaccaccacaaccagctaattttgtatttctattagagaaagggtttcgctatgttggccaggctggtctcaaactcctgacctcagttgattcgcctgcctcggcctcccaaattgctgggattacaagtgtgaaccactgtacccggccaagatccatgaattcttctgcacatcagacactacttatactttttacttggatcatctgatgtcttgacttccagaaatgcatttcccattgtttatgataataggagttcttttcctctttaaactctggtaagctgccaaaattcttcctggtatttagagggaaaatattttaaaatacttttttatgatattgtcaattctgatcctcttggttcacaaatataatttcatccatttatcctaattagtcttttgacttttagtctttgctcattttactttttaacctttgtcaatttatgtcatcttgatttggattcattttactttttaacctttgtcaatttatgtcatcttgatttggatgcatctttggaaaccattttccttctagagtaatacagagtatctggatctacattgacaggcctaagaagcaacttcaccacttactgctgagtgaccttggaaaaattatcaaaaatctctgggtcttagcatcttcatccataaaataagagtaataaaagtatcttatttgtatagttattgtgaggattatgcaaattaataaatataatgcacttgaaacagtgcttagcaaatgatgttatctcaacaagtgttaaatattcatataatttctttagatttacacatgtgagtccttaatagaaaccataatcaaatgtttacttgttcatagcccttctttggatcttctgtagtttaaatatttcctttcaaagatacagtgcaattacacacaataacttaaacaaggaattgtttattcactcagtatttattgtcaatcattatactattctgttcacaactttgaattcaagattaatattgctcggaagttattctaaaagcatagcatagaaatagaaaaaatgaagctgataattcaaggagctgcatgtcattatagaaatgtactggaacctggggaattgcatgacttatgatgaatatggaagcctggaaaaagcttcctaatgaagcactgattgaggcatggtcggtaagaaagaagatggaaaataaatcagggtgggcctgtacacatcacgtgagggcatgctgagagactatttcaatgctgaatgataagattgggtagtaggcctagaaactttgctttgggccatattataagggcttgatatgccaaaataaagctaatggatttaattttataggcagtagaaacaatggaagcctttacgcaacagaatccatgaatatattttgtttgagagaaattattctaattaaagcgaatagaaattggatgaagagaagcataataaagacaacctcaatagcttaaggaaatagtcgattacattactgagtacctgaagatgagaatctggaattaggagacatttctgaagtgaaagcatttgataacccattaaatatagaggaaagtgtgaaaggcattagtaatgacctgtaaacttctagcttgggacacagtgtacataaatgatgacagatgtgatggaagtcaagaaccaaggatgtagagttgattcaacagtcagttgataaattccattttggacatattgcatttgaggtacctatggctatctgaggcaggcagcctcttcgaaggcactcaataatcccttccgagtagcattcatgtctttctgaaatctgctccacctgagtaagggctgcactttttgacttgcttctaatgaatagaatatggcagaagcaaggaaatgttccttccaagattacattataaaagcactgtgggctgggcatggtggttcatgcctataatctcaacattttcggtggccaaggagggaggattgcttgagaccaggagtttgagaacagtctgcacaacatactgagaccctatctctacaaaaactttttaaaagttagctgggcatggtgggacacacctgtggtcccagctgggaggaggcagaggtgggaggatcacttgagcccaggagtttgaggctgcagtgagtcataatcattactttactccagcttgagtgacagagcaagaccctgtctcaaaataaaatgaaatatgataaaataaaataagtaaaagtaccgtggcttccaacttacatggaatctctctccccatctaccttagatcctttgctctggagaagccaggcaccatggcatgaggcagccctgtggagaggttcatgtggtacaggaccaggcctgcagcatcacttgagtgagccactaagcagattactccccccaccccaactgaaccttcatatgagactgcagctgtaactaacagcttaattgcaatcttgtcactttctaacaggccaccctgtttttctcaaactctatcactgatattttctcaaatatctatttatctatgtttggatgctgttttagttgctctctgtctccaccacttctacatcaaaagctttataatgtagtctgccttgcacagtgacacttagaagaatggctagcaactagtcactctaaacttattatctacttatcttttatcaataagagttatatttatgttacatataatcacaaacattggaagtaaatggcttttagcatggacaaggaggcgatataacatgatcaatgaagataataatataatcttaaagatgaataaaaatctgtttttatcatctctaatttaccaatcagtgcattcaatgatttctaaatatctcaacaattccaacatatagatacttttcttcctacttgatggatgagaaaattaagtctcttgatcagaagttaagtcacctgcctaaaaacacaaccagtatatagcagagttagaatatacatttatgtttgaatgcttctgtttatttacactaccttccctctggtactttagtgtttttcattataagtatgtaaaagctaaaatacaaaccactcaccctatttgattgcattcacaatacttttatgttgttttaccaaatttggattataatttaggagtgatatttacatctgggaattctggaagaagttgtgaagtttaattcctatgggaactcattatatattcattagttcaaaaacaaagaagcaaacagcatgcaccaatgaaggagcttgaagactgcctttctctcagtgctacccccaggaattaaacctcacaatttctttcctgtctaaacatgcttttaaaattgttctgacccaaaacagtattttcagacgtttctgataagtcctgaattgtttttttttctgtgtgttaatcctatgccattctttgttgtttttagtaagtactcaattctctcagattactaaggattctcttctctaaaaaaatactggcaaatttaatatcatattccataccaatgtatgagaagctgctagtcattttagttctcctagataactaacacatgtaaaattgaaccaaataatgccagaaaccaaatacataattcaacagcacatggtaatagctgggatactgatagttatactttttactttcattttattcattttatttgtggatgaaagatgctctatgatcttattccatcacaatattgataaccaacattttaaccattaatattaagagttagtgttcattggggctttcataatcttgttcataaaatttatttattaatgatgtttgggtaggtagctgttgagattgacaatagtattaataccagcaatgatgtgtgatgtgatatcaatgtttgtatccccgccctcaaataattgagctcccatgtatatggaatacatggtaactgttttattgttacatgcattagcattttcaataaccgtaggccatctcaatcaatttcccccatcatcccatgattgcaattttcttctatgcctattgaataatccagattaaagactatatatcatttaactcccagcctcaagtgatctgcccaccacatcctcccaatcattttacaatactttttgaagtagtcaagggcttatgtacatgattgtaggcttcgaagttctttttattttcaaaggcaaaattatagcggtgttgtccagaacacccttaaagttctcattttaaatgattgcaatctctgaatattatttcctctcaaattttgggatttcaaatccataatatctttatcttgatatataaattatgaatcacaattgggaaagctaccagggtttttaaccaataatctacaagactctaagtgtggttccaggatccacaaaaatagaattacctgagaaagtgctagaaatgcagattcctgggccccactccatactcaccgaatcagaaacttgagttggggaaatgaagtgccgtaatcatcaaaaataggtgatgcttgctaaagcaaactaatgttgaagagctactcagaatatggtaccgctatacttgtgtaacttacaaagacaaataaacctcaaatcacaaacataacacattcattgcaaagtaaagttaatagtcactcttctaagttattcatttataacgatctaacccataatcaccccacctttcacaaaggttgctgttacatcatttaataacttttaatgaagctgagttatttaaacttgacgttaagattaccatgtacccagattatcctaaaagcactcaattcacctatttaaggctaagaaaactctgtttatgacacttacaattcagttattcaagacaaataaatatttcctttacataattgcctcatttaaagagcaaaactgaaaagctaggttacggaatgaggaaaatttgagacacttaacttagatttaacaatgagcaatgtggtaaatttatgttgcatgtcttgcatatttaccagaatcacattatcaaaaatacacatacaaactttgtactaactttctaattattatatttcttggtggcggaaggagaggcaacataactcttttactgactatcacagataggtaagttttgaatgttaccactgttctcaaatatgtcttttctgttagtctcttaatcctgagtcgattctttttcagaacaaatgtaacccacaattgaaatgtaaagatatttatttcttagtgtcccattttctccttagaatacggtggattacttcaggaaagcaattttaccaagggaaatgtaaaatgcattttttatattgcaccaaaagaggtattcagtttttgtctgccatgtcctctgctgtattgcacatgaaagcaaaaggaaggcaattggaaatccttgccagaggctagttatgagcaatgagttcaaagatttcagtggcttgatacgtagtgcttaaaatatacgagtctaccctctcctttccttttttccttttttcattttgcaaaatgggaaacaacattgttctttcccaacgtggctttaaatagctcttccaatcttgttttcctgccccaggatgtcttaggcagcactcacaatctccctttgctcatctgtcttagggagctccagtcagctgcctttcctagagtatcacaggcatcaaccctttctataatatacatcatttcctttttggccaaaaaatacatgcagttctttaatttttgactctggaccactcattttgactcactgtggggcagtagcattcaatgacctcttccaaaacgagaggcactgagctcatagtttttaatgttcccctctcacactaagaactgcttgaatctaagtatctaggaatctaagagtcaattgaagaacagttttgctaacttaacttataagaatagagattgatattagtgcaagaaagtgaaagcatatgaggcacggaagtagtattgctatttttatgtacaaaagtaaaaatggaaatattggagtcaaggagaagactgaggtataacagacaactccaaatgactacatttgtcaccctaaaagtagcaagtgttttcttttttttttttttgagacggagtctcgctctgtcgcccaggccggactgcggactgcagtggcgcaatctcggctcactgcaagctccgcctcccgggttcacgccattctcctgcctcagcctccccagtagctgggactacaggcgcccgccaccgcgcccggctaattttttgtatttttagtagagacggggtttcaccttgttagccgcaagtgttttcaaaaacaaacagaatatccttgagcaagaggcttaatataaaacactattgataaggatacaattcagatattttttgaagtttatctcttttttcattcaacttgtggacccttaaatgggatttttaatactgaattataaagatgtttcaaaattgtaatttcaaatagaatgatcctgagagtacaatatttttaaaaagtatatggattccaaagtggttaggaagtcaataaataattccaataactgtataatttgtggttgagggcttaatgttgtggttgagggctaaactgaagagcaatcttatttaagaatgtgcaaagtaaaaataaatagcttaaaagaatatacaaaatataaaaaacccaaaattatatagcatatacccaaatctaggtagaggtatagattgttttacttaatcaatgtatgctaaccctgtgtatataagtccattttagataatatcaatatcattttaatttcactgaatgcaaattatccaagccaaagaaaagaccctccaacctctaggccaaatcttgtctaaaacaacttaatctgtcctatagtaagatcgggcgcatcaaattctttcccagccatccccacttgtttcccataccaacacttaataaataatagctaaaattatatacctacataatactgcattattgtccactctgaggcctaaatcatggcttcatcatatttctaaaacacagatcataaaacccattcaatgaaggcttctgtttcttgcaaaataaaacttcaaaattaccagagaggtaataatggtcaggttaatgcctgggttacattcaatactgaaatggtatataactctttttcccttaaggaccacaaaacagccttgtaaactcatcctagaggatctaaaagagaaccccctcataacagaatggcattcccagcttgcaggctctgagactccattgagtcatgccacatgtatggaaaatgatttttggagtgttattctatctaaggaaaaacaaagcaaattttccactttcaagattaaaggacattctgtctacattaagacaagcagggtaagtcttaaacacttgttaatcttagcactatgtttaacaagcctcccaagtattgaactcaagaaacctaagaaatgagatcaatgttagctttttcatgaaatttaaatgtgtcaaacaataaagtcttcaaatagtttgccattttttgctaacagggaaaattaagcagtgaattaatgacctcacaaggattttggagaatgctgggtaagtttactacactccacataagtataatatgcagatcctaattatttcacatcatatatttctattttgtacattgaaatcaggatcacgttaaaaacttttataaatgtagcacattaatattataggtatgttaatattataggtattaattaataggtaataatataggtatattgaatagccattttgtagataaaaagtgtttaatattggtaatttgacgtggttcaaactaatatatctataatatagacaaataagtaatagaccactcagtagactttaagaaataaatctattaatacctaaaggctgaagcaaaatacatttgtcagttaataggagagaattttccaggaatttgttagagatggaatgaaatgaccagtggatatgatacattttttaaaaattgagcgtgtcagataaataaatacactatgttttttaatactttaaagactatggaatgcctggggggacacaggcatgggtaatacagttgcctgaaaagacctcatcatcattaggttacagtggtgttgcttttgcattactgcagaatttaaaagaagatagagtagcagagttaaggccaaatattgcaatgattatataactgtaagtatgacacaaagtttccttccaatttagcagaaacaatgggcaaaaatatttttgatatttatgtaaaatagtggtcgctcttgatacacagatgatatgaaagaaccacatgtatcataaatcagtagctccttttagacctttggtaagcatactacactccgtataagtataatgagcagatcccaatcatttggagggggttcaaagttgctaaacagtgttgtagagatcaatcatggaaatacatgcttgctgtctctttgtgaattaaattttcgtgcagtgttgcaaaaaaaagttactatgtaaaagtaacacataaataaataagcttatctttcttcaagattatacttttcagcctggctatacaactggcctataaaacatgaagttatttcagttgtttaacaagaattcattctcaattccaccaaataatggtatcacaagttcatctcaaaacacaaattagtgattaatacatcaaaaaacttagtacaccaaaattgtagagagaatatgatgagcattgaaaggttagatggaaatactcttccgataccattgaccagagctcaaatgccctgttttcagatactgtcttgatcccatctaaaatataagccaattgtgtgagactatataccaattaaaatacaaaaactaaaataaagcgtaaaagaaggcaaaagaaaattgattactcattgcatgctattttttaaattcattaccttgaacattactaaacatatcctagaaaaggtcttatcttattaaactgtcctcaatgatttcaaactgttatttcttatgtaattttgttttctttgatcaatacttatgaatgaacacagtaagcctagtgtcagcaaatttgtaaactactttgttaaattttaacagcgtattataaaatattatgacataattttccaagtttcagtaaccatttgctgaatctgacagtttaatgtatttgacttcattgccagaatcacaatgctaaaaatatgtgtgggctctttaataataaaaaaagaaaatctattcattttcaagaaagctgctaccaaactactgaatatatttcaggtcaaagaataaaagaattatttttaattcaaatctaatgacataaaatggagtccttgctgcattctcccaagccaggtttagctgctctgttagatctgtctctatttaggggaaaaattgtgttttattctttctttagtctgcacaattgacctcttcttcttcctctttatcctcttctttttcttcccctcccctcttccttctctttctcctcctgttctcgtttcatcatcatcatcatcatcatcatcatcatcatcatcatcagctatgaatgggtttgtattcagagcactttgcaggttgggttcatgaacaaacgataaaaactttacccttcaggaatttgtactttgagaatggagctacagcataacacatacataagaaaaaacagtaagatatgccatatagtaagtgacaaacatttaagaaataactgttacaacaattcgaaaaagttattagtcctttaattctgactctctgactcaaggaaaattgcttggtcacctttttaaatgggcacagtgtgttaagatgagaggaaaggaaacatggagaaggaatctgcatttactcaactcctagtatgttccaggaattgtaataggcgcttttacctagtctttattacatctaactcacattaaacagacctaaacccaaagataatggtagagaaaattaattctcaaaatggagattttgaaaaaaatatggttgaataacacagattaagttacagagaaaatgaaggtggagaaaaggagccagggctttaacacaggtcatctgattgggaaaccaaaagtcaattggccactcattatgatggtcaattgaaaaactcctggcccttatacatatttaaaattcatggagacaatctgagtgggtggtttctgaattctagatcttatgactcaattacaactttctactgtgaaaggttgagcagagatttaaaatgctttaagttcaattattctgactaatattcaaagcattcttttcactgtaaaatggtttttttttttaacttgatgaaaaactaaaataacgtctctgagacaataaaccactaaatgaatctggctttggtaatacattggtactatttaaaacagagattctcaaagcctatggttggttttaaattgacaaaccacattcagtgtcatatctaagagttccattgttcaaacattgctcaatccttattttaataatgaattctattattgaatattgaaatattgaaaggtgtttgaagaaaaataaatataattccttactgccactcaaatgtacagtctgtggttccaaaaatttgaatttaaatgcccttattgtgggaaaaataaatttttaactagaaaaatggagaaatcatttggctcattctcccttctgcccacctcataatctttcttggaactgaaatggaagactacctcattttgttacatgacaattctttttttctctggatgtttgtgtgaggttttctcttagtttcctgtagagtttgaacccaatggcccttgactaaatagtgtgaccgtaaagtcaaagaacatttgatatttattaaaaagctgtaatcaatatttattaactagtgttaagatatattgacattagacactgcatatgaaatgcttagaacagtgcctggattattaaatattagctattattattaatattttccttgacaaataaatcatgctagtaaaagtacttaattatgtttctgatgttcaataacgaaactgaacagaaaaactgatatggtataggctgttaaaaatgaaagtgggccgggctcggtggctcacgcctgtaatcccagcactttgggaggcagaggcgggcggatcacgaggtcaggagatcgagaccatcctggctaacacagtgaaatgctgtctctactaaaaacacaaaaaattagctgggtgtggtggcgggcgcctgtagtcccagctattcgggaggctgaggcaggagaatggcgtgaacctgggaggtcgagcttgcagtgagccaagatagcccactgcactccagcctgggcgatgagcgagactccatctcaaaaaaacaaaaacaaaacaaaacaaaaacaaaatgaaagtggatatccaccaacacaggaaatgtgtagaagaatctcaaaaaatttttttttcaaaaaaaaaagctgtcaagttttggggggaaggtaatttggccgtgtactagttctttatttgaattattaactaaactttgttgcataaaacaacaatcggaataaatacaggtgtaaagtttttctcccatattttatttttgttaagaaagaataggtaattcaccattcaaataacctttctaatggggaatattaattgcaaccataaaaatgtagaaaatagtttcccagacattgaaagttctattataaatcaatgaagaatgctaattagcaaaatactttaattgcctcacttttacttgataaccaagaaaaagcatgaccatccccttttaggagacaatatgaacaatctcttttatgtttctagcatcattctcagggatagatttcatccaattcctctctttgatggaggtaagtaaagtaaaactcatcatttctcatatgataaaaatttaagtccaaaaacattaaacaattgaaacaatgtaagaaagtgtctttctttctttgggaaatcaatctggatatatacagcagttaatgttctaacatgttgacatctcttaatacacatcatttaaaagccgacagtcattcttccttttttctctgacctcagatttcctcatattataacttaattccctagtaaactctataaacagactccaataaggaactgagtctcatctttgaccaaagttatatttcccactcacaatttgaaaaaaaaatcagttatcttctgtttttctttctttatgttgttcacagtacaaagaagtaagttactgttggattaagaatatccaagacaatggtcacaacttgaaagcacatggaaaaacatgaattatttttataatgtcagctaatccacagctgtgccacctgttagtatggatgctatccaaaaggatttttgaaagtaagccaggcagtctgccttcgatgtatgaaaaagaaaactgtcaaacattttgaatggtgaggaggggtttttgcttgggggaaaatggagttcgcaatggacaaactagaagttatctcctgtatcctatgaatctctcatgagccattgtcttctgatgaattaaggaataattaatttctaaaaatcatgtcttagaagccatcactccaaggacactatcaatatctatctatctatcacgctgtacttctcatttagtctctttaaatatttaaactttaattcaaggaattaatgaagtaactatatcaagcactttcatttgaaaaggtgaattcactcattttaatgacattgtgaaaaatctattcatatccttcatctgaacaagatgttagaaatgtgttattgatattttggatctctgagataaacagtaccacagacactaaaagaaaccataattagcaactgatccaaggaaaatataaaatgacaaaattctaaaatgttatatctaaaccacagcagacataataaccacaacaatgcagaagttctacgaatatctattgaactttattaaaaatataactaattttccctactgacagatgttgtagaactacatttgaaaataccaagcggtaaaagtaatttcttacgcccaggaggacacttcaggttaagcacaatgctagtaaaagcacagctgtgaaatcttaggagagatttttcctatatgctttataaaatctgattctctatgtttcttttagccttgttatccaaatgcagaaatggcagctgaagagatgatttgtgacagcatttgctgagacgaagtctgtccactagatggataaaatcagttcccttttcataggtctgtgagtagccaacagctaagaagcaaattattaattcttacacttaaatgactgcttaaagatttttgatgttgtttttgttattttcttagccactagtctacagacttcaatgacatattaaggattataaatctattaataaaccagacacattctgtctctttaatttctttgcaatagttctccaaatattatactaccaatacttactggtaggcaatgatttagggacgaatttatttaaattgtaaaaaatcaaagatcagtgagggaaaaaaatcaaaatcatcaagaatacactaaagaaagactggtgtcaaagttgaaatttaatacattaaatatacagttgattcagcttcgactcaccaggttaaactcagggaaaatttcttagcagtaagcctctttatgtaagactcctaaaaggatctgaagatttgttttacttagaggtctttcgattgcaaagaatagagattcacccagagtagctgaaagatggggcagcatagttattattaaaatttgccgtgggataaagagatcctcagagcatactgagagtcatcttttccccgttctcaagaaagaaggccaattgaaccaattcatctttttggattcaattcacgacttacaagtcgtagattgctagtgcacttacagattggctgcccttgaaaaagttttcatatctggcaaagaaaagaagccagagttggtggtaaggaacacaaccataaattgcagatcatagctgatgactgcaatggaagcatgtgggggaggcagtccttcgaaggagtgtggctgccaggcaggcagctatggccatctagtgtagagagtggggttgaaagttcagaacctggactcattctgattgcattgagcccagctctactatttactacgatgtgactttggtctagtcaattaatctatttggtatttattttcctcaacattagtaccacttaaggttattgtgaagagccaatgagttcatttaggtaaagtccttaggccagtgtctggaactgaaatcaccaggcagtataggttggccaatatttcctagtctcctacagccaaagctgcctctttttttcgttgattatagtggtgtctcttcttcagggatgatgtctgcttaaggaaaggtgaggttctagagtcatctttcaagataaaaataatcttacacacacaaaaaatgtctgaagagacttttagtcagcctataagctgtactgtatattaaatatactttatattaagtacaatatacagtatatccttgtgtgcatagattcctttatagtaatatgtgtgtataaatgtataaagtatatgatgaaggggtctcttgtcaacaataattgtacagtattttaaataatgagatagatcaacattaacattgatatgaaaaacaaagaaaataaacctgtaccctctcctttcatttatgtattcttgttggttttaataaattaaagatacgctgaaatgacaaataggttagtgctattgagctaaggatgaacaatgaccattgaactttggctgtatattgctgtttgaaatgatggaactggtcatttgatcacattcagcttgatcatctacatctgctagtgacccagtccctgagagtcaccaagaattgattccactgaggcgatggcaggcggggctttggtgttggaaaagtcagtggttgatatggacagcacagactcacataagctgctggtttattacactagaaaaataaggtgagtgacactgtggctgttatcttttgtgctgatcaaaactttctggtatactccatgtaattttgagacctgtttcataaaatgttcatgttcagaaattaaagccatcagggttttggctgtttggaacagttcagccaatttatgaagactccaacctgctggctctttctgtcccttgctgttttctttttatctctatacagttttgttgctccctttacttattgattcatcagccttcctctgtaaagccctcctaattcagcaaggccttcattagggctgtccatgaagagatggtcacccacttgtctggccacccgaatgtgtattcaccaattcactcctaattagaaacccaaaaatcatttacgtattttctcgtaagatttggcaaaatgttctagaaacagttgcatggctacaagtcataaacgcctacctgttaaatcttcatcaaaatatctttattcactttgctcaacccctctgtagtaactggggtccttgttgccatgattttgtgacaatggctcttgattttggtgacagatgatgctaggtttattatggccatagtaaagaccaaattcaaaacactcttttctttttttcctttttttttttctatactagaatatcattgttttggctgcacacaagatgaagtaagtggctttcatttagaggccatgttttaccaaaaaatatgtttcttaaaatactagattcccctcagcataatgagatactcacttttggggagggtgtcagaaattgctggagcaacagattaatgatccccatttcagtttcacatcaggcatgggctcattgaacacaatggctggtgggtgaagtcacccatactgttaaattatcctctctctctgactgaacacatatgcttaaattaggataaaagttaggactattctcaattgtcttttaaagcttgagaggggagtgggctctcactatgaagaaaaatatatttcttaagacggatgatctttttaaatgcttaaacaccaagtatatatattttcgaacatagcaaattgcaattaattaatgaatccactgaattttaccttctagttgaatttgcaaggtcatatgagtaaacactgatgtgaattttaagtcttggtgacatgtaacaggaaagacaaggtctaaattttaagaaaagactgaaaagccacttacttcttgcaaatggaagaaaactctgtgctatttgaattattgtttaagaaaatcctatgcagtttaagaaaaacaggataagaactaacacaaaatgctgcttttctttagacagatcattaagtctctccacctaaactcttgaaaaatctgtaacgattttgtctgcttgtcaaattgctcctccagtaatttcacagttacaacccacgcacatatcgacagagcatttcgattcaaatgtaactttctaacaacaaacttatatagaaaaggtgtcataggcgtaattgagaggaacagaagatcaagagtgaagaaaattacatcttcttttctcaattaagaaaaaaacctaaatcataaatattgtattcatatacatttacaaactgatagaccactaaacgttttttctgatttaaaactgctttccaccactgctgctggtgcatatattaatgaggaaaaacccactgtgacagaaatcttcccctcacggcatagccacctccacccccataaaagaaagcttttcagtgttacctgagaaaaaaacatcacaactaattacatcatttttcttggttcccgcatctaccaaggcttgctcagacacattcaacctgttaccacaatccatgatttaactcaaggttttatttagtgtaatgaatatcattcctctatttaaaatgctgtttatctttccttaagcaaattgatcggccaataagtatcattattaggtattacaaaaaagatgttgtcataaggtaatttattctaagttaaaatagtccactgagatgtcttgtaagaacagaaattaccattaaaatgtcccatttacaatcactgatgaaaacttgggctatttgtgcatataataaagggagctgaggttttttaatttaaaaatagatcacatgctattaatgtagatttttgtgtttctattacagattatcatgaataagggtactaaggactaaaattgggaaatcaacttatctattatctcttgcttatataaaaccttcatgtatttaatatcgatggtcctttattacgtgtgtgtgtgtgtgtgtatgcaccatatatgcctcaaagtatgtgtgtgtacattaagagaagaaacccagcatagctaaatggctaaaaatatggtaactatactgtgcttccaccctatatattttatcacataaaatacagttttttacgataagtgcctttatatacatttgaaattaactttgacagctgaatctttttcaacactactcttgaatattacctttatgtagtattacctgtgttactgcttcagtactaagaaaatgagaccattttctctgacattacataagcccgacagcagacgagagaaacgctgcctatctggggtgaaagctagctccctctgaagctaccatttgacacgttaaaacaattctcgagttgattgaatcattccaaattaccaatatttgaccatttcaaccttcaaaaatggaaatttcactttaactcatacagccagatatacctagacaagctttaaaaacacataaaaaaatttcctttaacattattactcagaagttgattacagtcaactatatagaaaggaaaatcttaacgcttccatacaccctgaaaatttatgaacttttgctccatctgcttaaacctatattgcatcctcgtttttagtttttattttttaaagattgttttaaaaaggtgcaccaatcaaaagataattaatggtcttggtctttgttctatcagatgtccatgcaaagatatggataatggttccatcaccaaatttttaactaactccaaatattgtatttgtggctcacactagggatcccttgacccagctcggcaagtgtgaaatcacgaaataaatgaaggttaacaaagactggtctaaggaatagttcactacaataccgcaatgctcttctcactaatactcgactctgcatttcggtacttatatctgaaagatttgcaaataatgacaacattcgtgccagacattactgcaagtgaggaacagactaaaggagaggaaggaacaaaatgccttccaagagagaaacattcattagccttactggcaagtgtctaaagcaaacaaggaaactgcaaaataattacttagttacaaataaacgcttttagcacagtacctttttgtgtctgtccctcttccatattctcttccatggctacctttcttcagtagaatctggtacacggaattaatcaaaagctcaattagatgttggaaaaactgggggtttttttttttttttttttttttttttttttttttttttcctgggaagctccaacagcagtggcttgggcaagtcctcagagcttagctcaggctccctcgttcctcttgtttgcttggagacaggctgtcaagtgtaatttcattcaaattactcttccgtgaagattatcaatttttcttctcaaagctgcccattgtgtaccactgtaagcaggtattcaaacaaatagcctgagaattttggggggaaatttggtctgaatcccaggagcagagacactatgattcacaagtcttgctttgcatttaaaatggggaaaagaaattgaggtttgtattgaaatctgggctttaaattggaaacaggctgagctgtgaacagatggaggggtgtcctcctaacatgaagccgaccaccaacccgtaattccccccttcattccagagtgggaaagcccagattcccgtcggttctttatgctgcagcagtggcttctcacccagtcagatacgttgcaaaaaaactgtgttttccttttctctcctcactaagtatttagttaatttgatttaaggtgccaagaaaggatgcagttataccatctcagggtttatctgcaaaagtttattactaagacaggacttgtaatcccacacctttgagatttaaaaagaaatagaagcgtggctgtcaaaggagtgagtataaagctctaagcctgagagatacatgttttaagtaattattttacttagtgccatatgactcttaagtaaaagggagaaaaccactggaaggaaaaaccctattgatgtctttgttatttattgttatgattatagcccacgaaagctgctggtttccaatgagaatctcttgaaagggaatttctttaaaggtcagtgttagggaatgagaagagtgatgtaagggaggaacaaattttagataagaaacaagaggatagcaatttataatgggaatctgcaagctgatttggaatgcaaatcacaatgctgcagtctggcgataattagcatttgtacttcagcctactgagtgacagggcacagtccaagagtctcaatacttcacaaaaggtatagcaagaaaataaacagtatctctttcaaggagcataaacctttcctagagtagaaagaaaggatccttgcctctgtcttcatctccaaatcagccagcacacacacacacagggacagaaacacacacagagggacagaaagacacacacaagcacacacacggagaggcacacacacacacaaggacacacacacagacataactgtaactctctgcctttaatgaaaaatagctcacatcctcattatccatagcatacgtttcttgcattatagcttgtatttcacatgcattctttaaagcaggccagtagcatgctgcacatcaccctctaaatattacaaaagcagctatttagaggaaacacaattactgcattccactttatttctcataaatgaatgtttagtcctcttacttgtataatcatttgttattattttctcttttcaaatgaattttgtccaaaaataactggagttcaaataactcaaaacctatctctttggaatatatatcaatgtgtattcaagggtttttgagagagctgcttgctcagtgcacagattgagagagagaaaccataagggaaatcaaaaagccaaattgtagcagcctctctgcttcaactcatccctaggctgacataacctggcatataatcaacacagaacggagcaacgctcctcatttagatccttcattcgttttataccatggaaatcattagtgaaagcaattgtttattgtagtgccagtagatacaataatgtcaccttaaatttttagaacactttacaatctataaaacatgattacatacattaacccgttgtaagtcaaatgggaaaagcataattttccccactttatgatgaaaacaaaaaacaaaaaacacggatgctcagggacacctagagactgggctaataaatcaccaagtaagtcttagaacccatgtctgttgatttcttgcctaatgttctgatcttagaagctaattttccttcctactctgttcctttatgagtatcttcagcatcttcagaaatcagcctcagttcatagctttctttttcaccacacatataaagcaaaagagggaaatgagagggaaaggaaattttaaaaatattcatgatttctttttcttctggaaattttgcagcagaatacactcatataaccattcactttttgtctaaaacaggctttttcatgtgacaattgttaccaacataagtcaacatcaacttgtaccaatttttaaaatatacaaaaaagtcctcagagccagtccaaatggactcgtcaaatgaattaagagagatgcatacacatacatagcctcctcacagcaatcacctgtcagtaggctttcagtatttattggggtaaaatataaaagaaaaatttgccattttgatcatttttaaatctgtagttcagtggcattaggtacattcacatcattctgtaaccatggccaccagctatctccaggactttttcatctccacaaactgaaactctgtgcccattaaaaacgcactcctcctttccccttcctcctgtttgatggcagttgagttgttgatgattttctcttttttttttgagatggagtctcgttcttttgcccaggccagagtgcagtggcatgatctcagctcactgcaacttctgcctccagggtttgagcaattctcctgcctcagcctcccgagtagctgggatttcaggcatgcaccaccacacccagttagtttttgtatttttagtggagaccgggttggtttcaccatgttggccaggctggtgtcaaattcctgacctcaggtgatccacccacctcggcctcccagagtgctgggattacaggcgtgagccaccaagcccagccaagttgttgttgctaatggtggttttaagattattttttaaaatttggatctcattggaagtaaaaatattttgaacctccagtatcttaaactagttagaaaagaaaatcgtttcacattatagtagatttgctttattaattataaaatatactatataaagcttaataactagcaatgatgtgtccttatggggactgaaatgcctcatctaatactctttccattgtatcgtattgtatttgccccattctactcttagtcatttatttaaaatatatgggctgtaggcagtggctcatgcctgtaatcaaaacacattttgaggccaggagtttgagaccagcctaggcaacatagacagtcctcatcactacaaatattttctactctttttcttttcttttttttttttttttgagatggagttttgctcttgttgaccaggctggagtgcaatggcatgatctcagctcactagaacctctgcctcccggattcaagcgattctcctgcctcagcctcccaagtatcgaggattacaggcatgtgtcaccatgcccagttaattttgtatttttagcagagacggggtttctccatgttggtcaggctggtctcgaactcccaacctcaggtgatccgcctacctcggcctcccaaagtgctgggattacaggcgtgagccaccacacctggccattacagacactttaaaaaaacaaattatccaaccatggtggtgcacacctatagtcccagctactggggaggctgaggcaggggaatcacgggagcccgggaggttgaggctgcagtgagctatgctcacatcaccgcactgcagcctgggccacagggtaggaccctgcctctaaaaaataaaataaaacaaatataagttaactaggtggttaaaaatatgattatatttttatcaagtcagatttccctttcaaatactgtctaagaaatgtttataatgtatattacttttttcttatgtgagctcactcaatccaaaaccattataattctctttcatttttcttaatcttaatttggagcttcctttaacacttcatcttgtctttatggataaacacattattatatacaataagtaaatatcgacatattcctctattatgtaatgcagtcatctttgtgatacaatgttcataatatagacaagtaaggagagttaacagattaaagaagttgtggttccaaatatcgcattaactataaaaagtgagggggaaaaatgttcgtagtccctgggtcagagaacagagaggagatgtggaaaagaagatcatgaaaacctagcccagtgcataggactaacaggcaggaacacggtttagaaactgccttttattctacgtcaaatgtttcagacacagaattaacattatctctagaatgaaatgtcttagttgggatcttcttatattttgacagagaaaaaggacccctttgtctgctgctttaagctccaagtcagaaactgactttcataacattttcttttcttttttttatttttattttttttttgagacggagtctcgctcaaagcccaggctggagtgcagcggcgcggtctcggctcactgcaagctccgcctcccgggttcacgccattctcctgcctcagcctcccgaggagctgggactacaccccgccaccacgcccggctaattttttttgtatttgtagtagagatggggtttcaccgtggtagccaggatggtctcgatctcctgacttcgtgatccgcccgcctcggcctcccaaagtgctgggattacgggcgtgagccaccgccccgcggccaacattttcttaaagaaagtcaaaaccaccacaaacactgcaatgttttcagtccattataaaatgaccataacattcttcagagttacataatcatagaaagcagtcaattcacagaatgatcgtggtgttcacagtagtatcattaccccatttcctttcattctgaattgtaaaagtgtttactaagcattcttacaggaaattgatgtaggcaaaagggatactaagaagacaaattcctgccctaattaggcctatagcctagcagcgtaggacagaccaaatatcacaacgctgaatgacaagtgctaccaaataaaaataaagatgcattggatggcacatgagcctacctcaaggatatctaacctatatttagttttgatagttggaaaagttttcctggtttcctagaaggtacagtttgatctgacctgatcaaagcaggtgacctttcacccaaaggagatgaaattagatgggaaaaaagggggaggcagattgttggggagaaagaaaagatattctgaacagttgaaagagaatacatgaaggcctatggagggggagacatactctgctgagaacatgtaatagactaacatctggctgcatgggcagaaactctcttttactatttattagacattgtaccccccaaggtattcagtagtctcgtgctggaatatccaattctgagtcttgctccttagcttttttagagtactgaagaagaagacgctcctaagacctagcttgtactccataagtttggagcctaaaggtagacaatggcaaacccgttaatatttacccccaagaaattacctttcgggtatcttaggctctttcttaccaagacctttcctctccaatctattaatattgtattttcacataattaccagggctgtagtcatgagtatgtcataggcctgtttacaactggtgaatgcttttccagtgttcttaggatagaactggctggaaagattggacatgacctggcaggagctcacctcttcggcataacgtccccctgctgttcattcattcatctccttctaatttcttaaaattgtccatttgtgaatgttgtttcttcttcctaaaacacttttccttccaccctcagatagctagatctactcagatctcagctggaaagtgttatcctcaggcaaaactttttcaagagcataggcctcttttagtattcatatcacatgccattacagagctattcctcaaagtctgcaatatacatatagatatagtctgcaatatatatatagagagagagtcagttctatatatatgtatcttcccccctggcctgcggcctataagctccatgagataatggcctctatctttccccctcacacaagacaagcacatggtaagctttcaatagatacttgttgaatgcatgcatgcatgcatgaatgactgaataaacgaataatgatgtacaaataaatgaatgaacaaactcagtggcttacacataccttatcttatgtttatctgcttccacaaaatattttagagggtgaacataatttacaataacttggggagatacatatcatgttcatatgtaacaaatgtcattccccagcagttgaaggcaaaacgataatgagatatttcaaagagcaaccagcaaaacaaaaagggagctgggaaatattaattgtgtttcatctttcctctaggaagggaaagctgtattgtcataaatgctgattacagtaaggggagacagaaaaattcaagggtgacactctttgggccaaacttacccttttatagaaagatcagttctaagtacttatgcattcctataaccataaaggtgatccaaattttaaaacttctaaatagttttgttttctccaaaatgccagaaagcaagagtaatccaaatctctttctggtaattatgtttcccataaaacatggcagaaagcatgaggggttaaaaactatgcaatgggtaagcagcagtggcctctgtttactcaaaatccaaacactactactaattgagaaagagatcacaaaaattggcccaagctgattctctgtggtcacaaaaattctactttaaattgagctcaccaaagaataaactttatagctcactctgtcactcaagttgcatttactcaatgactactaggtatctgaagctgagccaggtgaacaggacagatgtagtttcctgctctaacagagctaatagcaaagatggaagagagagacaaacaattggaacaaagtatgataggtgcaattatattaatattaatgacaattatactcagcacttcacatgtgtgaggcattgttctaagtttctaaaaagtgtatatcccatttaaccttcaccacaacagccctgtcaggtaattactattgtccccattttgatagaggaggaaatcgaaacaaaaagattaaattctttgtagcaagtaacagggtggggaagatgggatttaaacataggcattctgaccccaaagcccattctttgaaccacctggatatccgcctacacttatgtaagtagtagacccaaaggcatttaatgtaggaaaaggccctgattgtaaagtcttctcacaacatgaatatttgtattcatccaaaaacaaaaacatttaactgcttcccatatgcccaacatgttgccagatgctgtgagagacacacaaaaaagttgaagaaatgattctcatactcaaagaacttacgattgaagttaaaaatattaatactcagtttaaacagcaataaatcaacaaaagtgtgatttcagagtaaaactactatagggagttgaagtagagaacgttctttaagatttctaatatgcttgatagctttcgtcaacaaatgcaattatcatctaagcggtttagcagaaatatggagacttttactcagtggacgtatctctgatcttcaaactctattcagtgccacaatttagccattaggactttatgcacagttattattccttcttattttctttttttaaattagctcttgagaccaaaataataaacacttgtactaccacccaacatagaaaataaagtataaagtcgattatacgtgttctctaactgcattcctttccttatatcttcttcagccctacctcctgttaataatcactcaggactggagagtttttattcctgtatgttgtccttattatttaatatgtgtgtgcatgcatatgtgtgtctgtgtgtatacagatatatatacacaccatagttagtattgttttgtaggttttcttttttcttttctttcttttttttttttttttttgagatggagtcttgctctgttgcccaggctggagtgcagtggtgcaatctctgctcactgcaacctccccttcccgggttcaagtgattctcctgcctcagcctcccaagtactgggattacaggcatgcgccaccacgcccagctaatttttatattttcagtagtgacagggtttcaccatgttggccggctggtctcaaacttctgacctcaagtgatccacctacctcagcctcccaaagtgctgggattacaggcatgagccaccacacccggcctgttttgtaggttttgattagatatcaagaatatcttcttatatgtctcttttcgcaacttcttcctcaatcttttaatgtatatgcggatctgttgataaacatttaatattgtttctaatttctaaacaactgtaaaaaattacaatgaatatttttatatatgtttagtgcatacatttaaaattttccctacaagtctgaggtgtatgtatgtgtggaatcattgggtaggagattatgtatgtcttcaataatatgtgtgttaaaaagcccttcaaagtgcttgtgccaatttaaatttccctaagaactatctgagaatcctactgttctacgtcttctatacttagtaatttttaaatgttaccaaagataaatcttttaatttacatgagtattaattatatatcttaatatgatttccttaagtatctcataaagttgagaacattttcttgcaattagccaatgattttcctcttttgagaaatgtatattcatgcccttcactcatttgcccacagtattgtttgctttttggtattattctatagatgttatttgtaagttctgaatactaattccatagcaattaaatgtctaacatatatatttttacagtgccttagttaatcttggtttttggtcatctatatatattttagaatcagctttcaaatataatgagggggaggtgaacttatatttattgaacttaaattaacttcatagattaatgagacataattaacatttttacaaaattgaatctctttccatgaacatgagatctctttccatatgttgagaactttttttcatatattttaagaatgttttaaaatgttctccctaggagctttgcatatttttttttgtttttattcctaagtattttgatttcttttagaggtattttatactaaatctctcaagactttttttgactgaagcaaaggaacacattattggattttaaaaatcagtcctataagaagcaaatttgctaaactctcctatagttctaataatgcataggtcttgaaatttctatgtagaaattcacatatttgaattaaaacaaatatgagtctaactgtccaatctatatattttaatttatttcctctgttttactgtgcattctagggtccccaacacagtgttgaattgagcagtgattttaaaagaaatgattctatggtttcattattatgtgttatttgtagtaggtttgcatagacattttttatctgtttaaataagttcccttctagtacacatttctgaggttcatttattataaagtattgaatcagaaaaaatgttttattctccatcaagtaagatgattatacaaattgcatccatttatatattaaagtaagaattgcatttgtagattttctgatgttaaactctgtttgcattcccaaacagagaattggtcatgatatgtaattgctttaatttcaatttaatattttgaaaacttcttttaattggaaatcttatccttttctatctatttttctctaaacatacataatgcctttttaaaaagctgtccactttaggagaatcgtttattaaaatttttggtatatccaaaaatgggaatactgtatagcagttaatgattacataagttgtctgtattaacaatgaaaagctgttcacaataaagtgatagaagtatataacaacagtataaatagtatccttttgtattttaaaatgttcataaacatatgcattgaaacaaacctatacagatctattggaaaatgttaagagtgcttatttctagaaagtggtatttgagataatttatttaattcttttcatgcttttttttttgttttttgaaaacattgtactttaagttctgggatacatgtgcagaactgcaggtttgttacataggtatacatgtgccatggtgatatgctgcacctatcaactcgtcatctaggctttaagacctgcatgcattaggtatttgtcctagtgttctccctccccttgcccccagcctctggcaggccccggtgtgtgatgttcccctccctgtgtccatgtgttctcatctctttacatgctttttgatactttttatataggtacaatattattttaattatcagaaaacttaataattttacaaaactgacaataataagttggttaccactaactgcagctaaaatgttatagacattgggctggcgatttttataattttttttctaacattcgtaacacctctgcaagatagctttctttcatgtgagaaaattgaggctttcaaaggttaagcaactttctcaaggctacgcagctggtgaatgaggaactgagatttgaattttggtttccctaatactaaacttatatcactcaaaagataagtcattcaatacttgattaacacagttgttagccaacacatgttagcttttcttcagttttgagtaaaggcttagtgctatattaacaacaatgaacataggttataacttatctgaaaagtggatgattttttttggctccattcacttgaaccaatatttaacaataagatacgtcagttaagcctaaccttacatattggatattgcaaatgacagtcttgcaaaaataaatagataagtgcaagagagaaagaaaaagacagacaagggggaggggtgtaaatacaactttatgcaaaactagtggcttgccataagtcctgaattttgaaacagtgattttaaattgttgctttgaatctcactgcagatgcagatggtaggagatatcctctgaaaaagctgattacactatatggtgcatagaggactgatgaggaaaaacaagactcaagttttctcagctttatcataagcgttttggtatttttgcttatacgttaaattgcaagtcctctgtggatgaaaaaaatacattaaagtgtactcttacatttccagagatcactttaggtaacctaaaaattcttatctcaaaaaagaaaactcagactgacaacttttctcattctttaaagtgccttgcccaacacatctgaactaatgactaaaaaggctgggagcctggacttctcccaatgggcaatcaaggtgaaaggcccttcctttcttacttctgagagaaaggtatgattttacacattgttcctttttttgtgagttaggcatctgaaatctttagagagtttgtcagttctgagcaagaggccttagattgtgatctactctccattaaggagaaaacaaataggcccacatcctgggtgttccagaaacacccggaaaacattttctcaaggatgttttattggccctgacatatggtctctttggatagatatttggccagaccatggctccaggaagattgatacactcaagtaatttacattctagacgttcctctgctgcaatgtgcacactgttattttcgaatgaacctgcagacaccacttgactccactctgcttgtgcggcagacacacaccccatccacttacaagtgttcttcacggttttcagcgatgtgctcaagtaagcagtaagcaacccgctgccattgtcctggacaaaatgcaaagctgttttcggcatttactattgcaaatattaaggtagatgtgatttatttcctctctctgacttcctgaatttcaatatcatttgtctgtagctcatatttgccagatatcatacattttttatttttaatatttcagtatgtctgatatccatttcccctgcctgtcattgtggtcagaaaccacgagctacacttgtttctcccttaccattcataaagtgagactgacgttgaacctattgcgaggtgcccagctttccagggactaggttcagctcttcttattcagtaatatttaacaaatatttgtgtggtatccactgtatgctaggcacatatttttttcttattatttacaaccctgagagtaagtggtatttctattttacagggtataagtctgaaatttagacaagcaaatgattttcacaagttctacaactacgaggaagcaaaatttgaatataaaagtctctcaaaagttcactgtttccaatacattaaatgactcagtaaacaaaaagtaaacagatgttgactaatcaattcctgcaaaagtgatgtaaatatatcttcaaaagatgtctttatttaagtcttaacgcttgtagctaaatgggtaggatgccagtataaatttctagatactttttgaggcatctcttcttgtatatctcttgtagcccataaagaatcttgaatataaattgaattgtaaatttaaaatcaatttaaaatttaaaaaccattatccttaaaaaacagagtgaatgttaaagtcacacaagccaaggttttacagataattgtactaggttaccttggggtgcagtaatcttaacagcaaaagtatatttcatgggagtagtatcagactatataataattgatttaagaggaaatgcaatatgcccaaagaaatccagcccaaggctagtctttcagtcattaattcattgattatatattgagtgcttaccattgcccagaggtaaatctaatttatagggcaagtccatgaacacatatactgggtcctcgctcccatggtctttagatttcagaagaggaatgtaagaggccaaataaacaaatacattaaggagctaatgtcaggttcttacatgggcaatgatgaaaatatatcagaatgaggcagtgaagagtgttttagaggctctgttagcttgtgttgtcaacctaaagatgatggcaatctttaacatcacccatagccaaaataataaaaatatgtcaaaatctctactatgaaatggtcattaatagaattttattgttcgttagaaaggaaagaagacaatgagcttgagcaatcagcagtggtcttgaatgtgctttttgtccagatgggatcttttgtaattatttttatgtggtacaacacaacattttcaagttgaacattttcaagtcaagttgaagagattcgcaaacttttagttaaaaaaaaaagtcttggctgggtgcggtggctcacaactgtaatctcagaattttgggagtccgaggagggcagattgcttgagcccaggagttcaagaccagcctggacaacatagcaaaaccccatctcaaaaaattagagggcatggtggagtgagcctctggtcccagttacttgggggactgaggcaggaggatgagctgagttccaggctgtagtgagccatgttcatgtcaatgcattccagcctgggtaccaaagggagacactgtctcaaaacaaacaaacaaacaaaaaaactgtctcttatcattcagtctcaaaaaccattggccactgatccgtaccataaggcttgaaagaccttaacatattacctaatgcagaaattaatctctctttctctctctctctctctctccccctcctcccctgctcagtggcgtacacgtgtgtgtgtgtgtgtgtatcgtgaattagggacaagattgagacacaagtctgtgtgactccaaagctatcacactttccattataaaacactgctttttaaatgtaatactattatgtggtcattgcatatttctgagttgttaatatagtagtttcgacattaggttgacttttgattccgttcactaaaggaggtaaatattgctatgcataaaatgaaagatggaacggaaaactggggtggtagaagagggtgctaataatcagccttctctgagtggttcacaaagaagtgaatacagagacatgcaatttgtgcagtgaaatttaaaacaccttttgtaagtcaacaaaaacaagtttctcatggctcagaaaagagagcttcctgagttttttattaataaactcatgttacaaccagcatgcccatgtataccaagtcaggcagcaaaagaaaatggagagatcactagccttttaggaaaaaaaaaagagtcctaatgttgatttatttctttattaacaagtaatctgtcggtttactccactctgtgtgaagatgtaccactaactcattacacgacttcaggcgaagatgttttttatctacttcctcaaatacagaatgaatttaacacttgtctcactgacttcacaaggtgaagtcactgcactaaatgttttaggtacaagatctcattttatccctccaagatgcccatgaagtaagtatcattaattaaagctattttacagacgaggaaaatggggcttcagaaaaatagattctctaatgacagaagatgaaaaatttctttgaataatataaaatgctatacaaaaatgatgtaattatatccattttaaacaggaaacagtgaagcatgtatgctgtagaaaaaaatgtcaactatatttagtagctcagtaagaccacccgatataactcatgtaataatacaaaacgtttagttagagcttatatatgccaaccgcaggtcttagcatttatgtcctcactttaattcattaatcttcaaaataaccctgtgaggtacatagtattattatccccacttcgcagctaaagaaacacagaaacagaacaagtgacttgttccaggtaacagctagtaaacggcagagctgggactagaacccagaaggtctggttcttaaacctgcgctcttcatcataacactgcttctatgaagcaggctggaaagggtgcaaaccaattagctatttattcaacaggcttagagaacaaatagctggattatttctcattgcgcacaagccttcgggccattctctaggctctgttggtttggtccgcatgatgttctgtaaggagcaatcagagtttcaaatggcagctcagccagccctgttcatcctccatgacctctttaaggttctgtttcccattcgtaaatgaggaaaagaatacctattcatcagggatttagtgaggatcaaatgcattccgcacaaattttggcacagacatggttggcactcagtaaacattagtctgcttcttcctctggcctcaaatgtggtgtcagttcaaataatttattctcccataaactaggaaaagctaagagaaaggcctcagatcatgaaatatcaggttttaaatcaactgtatattgttctgagtgatgaagcaatgtgcttttgtgaaaataatgttatcctgagtatttataaataggtctttttccctaaaacattgtatattcatatactgatttctcagaggtcagtatatgcaatttgaaaaactagtggactgatctggcttggcaattcctaggtcagttctatacttgctcatgccacaggtctgccaaaacaaattttatcaccaagtagaattgtcttgtaacagttattagtcagggtagaaggcaagatacagcctgctaagaaaccacatggaaatatttgaaagcacgtgagtttttcaaattgttaattgtgtcaaaaatttagcagggggcatattttgaatttgttatgtgcttgaactttggatggttccatggcctcatttttaaattgtattttaattgttcctgaaatagaaaaaaactaagaagatgacaatcttgctgtgttgtttgaagacaattgttattctttacagagtgattctgctgtttacaaacaaaatatttatgtttgtaagagtattcatattacaaatgctctttaatcccctaatgcaaagagtttttaattaggttaataaaattagcttaattgcttaaaatctttttacttctgtggccctaacagatttctaaattcgaatctgtggatgaacatttgaaatacaataagcaaaataataataacaaaggcagtaattataagtagacttatagaacccatagatcttatgaattatcaaaatgatttagaaattcacatttgcaaagtaaattttaattacaataaactttatcttttaatgatataaaatatatttacataaatagaaagactgtaaatttatattggcattacaaacatttcaaattttaaaattataaatagtgttaatctttttgttttgttttgttttgagacagggtttgatttcagttgtccaggctggagtgcagtggcaccgtcttggctcactgcaacctccacctccccagctaaatcaatcttcccacctcagcctcccaagtagctggaactacaagcatgtgccagcgtgcagcatgtctggctaattttttgtattttttgtagactgggttttgccatgttgcccaggctggtctcgaaatcctgagctcaagcaacccacctgccttggccttccaaagtgctgggagccaccaggcatgagccactgggcctggccaagaatgttaaactttttgtacatctaaaataaatagaaaatggactcgatatagtttagttataaccataatcatatcaagacagggggaaagtttcaagttgaaagattatttagtaatatccttttagattaaattatatgattaaaaaatacaactctctattttaataccaacaataatttgttaaagacactgtgttggggaaattgtaacctacttaagttaaataaaatattaaagtcagttaaacagtgaagtcagtggtatagttggatgccaagtgaaaacgtgtttttctcactattttacttggagagctgtccgctgggggtttttagcagtttccaggttttgcatgtggacacttcaataaccttatttcagaaaaactaccaaaataagtcatttatgtaatatatatatatatatacatataaaacatatatatattacatatatgtatatatattacatatatatgtatatataggaaatatataagatatatatatagatatatatatcttactcatttttcttggagaatctgggaagttactataaaactaaatggaggacatgacattttgtgaccataaaactaaatgcaggttactagaaaacctaatgcaaaatctgccacaaatagttttatgtaatacatattaatctcagatttggatactataagatcaatttcttataattgccgtaatctgggcaaaagaggtcaaactaagcccagtgtctaggcatagtagttggctctgcatgaagtggacatccatcctctgagtttaatagatccactgccactgatttgaggcagggaacagaggaccagagaaaggagagagagagaatgagacagaagggaggaaaatgcacatgaatatggagaggtgggggcatgagaatcaacaaagatctatcgttgggtggtgatggttgagctggtcatgtgagtttggggcccatgagctagcagtgatgaaaatcactttgttttttatttttattgagcatcactcagtgaggttgtgttaaatgccacagtctgattgcattaaacttgggcacgtttgctacatcacattttttagacacataaatacacgaatgctattcacaactttatatgttataactatgtaggccaaagtgtatataaaataatgatgatgtaataatagtagctaatgcttatataagccctttttatgcaccggacactgttcttcacacatatatcatcccatttaatcttcaccatacctctattaggtggtcactaatattacgcccattgttttcatataaaaactaaggcataaaggatttaagtgatttaccaagatcatatcactcataagtggcaataaatggcagagttgagattcaaagcaagtaggtttcttcagcgtccatatctttcatccattttgaataaagagtgtataaataaaatagaaggttcttactatatatgtcacgtatgcatgccgccattctgtacttactgatttcactcaatgtgtttgttcagggtcattggtagaatctccattatttctgttttttttttcatattgatttgttcgtttatatatcctgactcacttttgcctgtatctccatatatacccctatactaactgggttggggaaaaaaaaaggaagtggaacaactttgatttaattggacaatttttatttatcccctaaactggaaaagaaatctaaattgctgagtttatttgactcctttatctcatttatttgtctattttaaaaaaatacaattccttttcattgggactaatgtctattattagcatctatttctacttgtccttttattgtcaactagaaattaaagccagagttttatcaaaacacatggagtggtagaaatgccctttatttaattactgcaaatccctgcagagccacactctggataaattaaactcactggatagaaaaaaaagaatttgaatctaatagattatatactttagcctgaagacaccaagaaagggaaaggtagaattattagtcaaaattgaaagtacctttgaatggctgtgctctgcttattgtaacattgacttcttcggtacattttcttaaataaaagctcaaaacactaagcttacattttcaaagtctaaattactttatgcctgactatagacagtaatttattttgaacagaccaatctcccaattcttcaaacacaaatttcctagcatgaaatttaaaatactccattgatgggccccatgtcaagaaagtaacatctttttctgttttgcaaaacaaatccgtgcttaattagattcattgacaggctactcccacccttctccacctcctagggagtcccctgcaatttgatttcccttcagttcatttccccaatattgttttctcaaaggtcacaaatagaacttgttaaggcccatttagccatctctttttttttttttttttttttttgacggaggttcacttttgtcgcccaggctggagtgcgctatcttagctcttggctctgcaagctcctcctcctgggttcaagtgattctcctgcctcagcctcccgagtagctgggactgcagacacgtgccaccacacccggctaatttttgtatttttagtagagacgggatttcaccacgttgaccaggttggtcttgaactcttgacctcaggtgatccaccctcctcggcttgccaaagtgctgggctgacaggcgtgagccaccgtgcctggcctaaccatcttaattctacttgacttcttaatgctggaagtaccttccctgatactcccttatctagatcagagcccccttgatctttcctcggattgccaactccctggctctttggttcttaaaattctggctctctaactttcctatttcctttctcaaagaattcaggaactcatttagtaacaaacaaacaaacaaataacaaactattattcttcagccaggtgactccaaaattattttctaatcttgatttttcaaaagtgtttgagatttaaacctcaacctcagctaaacaagaaagtagtatttttttctttataaagacaaggaggataaagcaaaataatgtagaatataatgttatgtgaaatacttgctattttaaggatttttcttttaagacaatatgttatatttatttatattcaaagttcctgatatagtttttattatgcatcataaattgtggtaggtactaaaaacatagaaatgaagtaaacgttatctacccacaggagcttaaagtctgtttagaatctggcagaaggaattagtgatagctggaccaacaggaaggaagcattaacttgggtattattttattgtcctagaaaattttcacatacttgacaaatagtagaatgttttatgtcttgatctctattttctaattcccccaaaccatgcaagatttctattctactcacatacaagtattatattgatctgttatattattgaaggctcttttaatgcaagagaaagaaaaccagctacaaccacctaaaatcaaatggggagtttcatggtgcacatccacaaagtggacatgtcaggacaggggaacatctggatcacaagaatgccggttcccaaagacaataaggatggtttccagcctctactatttctgcactgcgaagccatcatctccatttcagactttcccactaagcaggaaatacaattgccaacagcagctagcttcgtacctcaaagcaacaccagaaagaagaagcatttccatcgagggaaggagtgagtgtaaggagtatttcccccaaaaggtaagattgctttctcagaatatgggaggagctgagtagggcatgataaatgtcttctctggagaggctcttaacaaaaagcaaaaatatcatcagtaagaaattctggtgaaaattattagtatggataaagactcctgggggtgggcgggctaaagaaagaagacagaatgatgaaaaacagaaatcagtgacaaaggcagatttccatagcaaaaattatagaatgtgaaacaaggtggaccctttgtcccagctcctcctccttaccacctgtaggactctgtagaagcatgcagagacgcagctgaatgctagtccgtttgttttgttatgttttgtttttaaatccctttaccacatccgtaatccagttcatagagcaatcttcaatccttcatgcttttatatcttcctagataacaggtaacttctttggaataaggcaaggtataaacatgaaaacaaataaatatttttggtgaagtctaattcagcttcgtgttgttcccagtagagtaattaagatatattattttcctatttaactaatatggaaattaaaggacaaaatgtttaaacagtatgccctgacagtagatgagtcatagcagaaactgtgattccttgcagtcatctgaacttttctgcctaaccaccagtcacaaattattttgggtccctggtgggaacctcaaatcagctatacccagggcatcaaaccaagcagcagttactaggtctgagagagaagagagcagagagaaaatcagtctgataagcccttacatgagtcagtaagattgagaccacgatttcttgaattgtaagtgaagaaactgggctaaaaaattcccaagtccttccagagaagtgctgtaacgccgtctctgagctagtgcgtttcagaaaaagttggtcctattaggttttgtgtagctaccctactagatatcagagagactgacacctgcagtgacttcagaggaaagcagaggcagcactgccaaagaggccgtgactacccaaccgagagagatgtgttacgatttactcaactgtttatttgccaggcctttaatctgaaaatgatggcctggctttcataaaaccatgcaaaaatctgctatagaatgtccctacgcctcaattctggcttcgagcctggcagtgggggagggcaagtatatgcttccacaaaaggacaaaagactccaccatcccttagaattgttcggctgctttttttagtttgttttattcttggcttgcttgtttgcatgggtggttacaaaatctttaaaaagtgaaaaagagtgcagaattttcagtaccctgactcaaggatgcagtccactagcctattcacagtttgcatctctgaccttcacagactgattttctcttctttactccttttgtattgaatgtgtgctgtaaactcacattgcttgagtatgtacacaatgtctccactatatttctaatcctgcatggaacggattaaactatcagcattctctcacctgtgcacttttcccttaccaagaatttaaaaaaaaaacaactgtttataagtttagactaacaagagctgagagagcctgagtcataaaaatgataattataaccaatcttccaagtattattaccatcactactattagaaaacaaaaatacatctcttcttaattttattaaagccttccttaatcttttgcatctgatatctctcccaaagaaagagaagaacaaagaagcataaagattgattactggtaagtgtatttcttttcatccctggtatttacactgagtcaagagctcccttaccagccacatggcacctactctttctgtcctagaactaactacgctgcctttattcttccctttctttatcttttctccagcttctcctgctgagctcaccatgagatctcattgtgcattcatgccttgagaagacagtgctgccgaactttaccagattatcttgggcgcttgttaaaaattgccaattattgggagttcagaaatccccaataagacagcatagcccaggtctttgtactgtaccgtgcttctcctttggaccctatcgatatataaacagcacatgagaatatcatacactaagactaatctaaatgattaggaaacgtaaattttatctcatagtggaaattgacttgcttacttttattaactttagtataccatctttctcaaaaagcttacctcttcaagaatatggctgtcttggggaaccagacagagatcatcttctaaacctgactgtacgttttgatcatctgagaagattttaagaaaacatggatcccaaaacttactgtatacctagtgaaccagaaaatctggaggatgaaatacaaaaatatatttaaaattaaaaaccttctctgtcctccatttctaaccaccactatactgccaagaagcgccaatattgactcctggtgtgtgtacttcaaccccttttagcatacccaagtatatgtgtgtgtgagtgtgtgtatatatatatatatatatatatgcttgtatgtttgtgtataatatataatatatactttataaatatatataatatatactttacagtacatattaactatatataatatattattttttcaaataattatatttactaacattatataataaagcatatataatatatactttataaacctgttatatataatacataatttatatattataaatatttttatatgcatgtgcttgaaaaataggggctttcagaacatttacccaaaagccagaaagagaagagcataaaggtgtagaacgtggaaagttttttgtaggtctggcctggaagagatgcccatggttccactgacattccattggctagatctccatcatgtgactatgcctaattatagggggctgagaaatgtggtcctcagcctggcagccacttcccaggaacagctccacattataaagacagagtaggaatctttggcgagtatctggctttctctacctctctacccaattatgctctgttactgatattccctgaacacttgattccctctgtgtttctaatcaccatcctctctcaacctggagtgcacttctatacatacagcaagcctaatttttcttctgtctcggttccattttcttctgctcctcagatcctattcctttcgtagattctttcactcaactaatgtcttttgaggtgtaccacatgtcagaaattttttttaggtgatggagagcaaagagtaaactaaagggacaaaatatctgccctcttggagattacattcttggacaaataaacaaaatgtttaataagtaaaccacattgtatgatacatagtggtatgttctgaagagataaataaaaaaccatagaggaaaagtataaaatttacagaagtagggtaaaagttttagacaggttggccaaggaagacaacaatgagaacatgaatttaagtaaaaactttgaaaaagtgcagaataaaaagaaccaatgcaaatttcctaaggcaggaatatgttagaaaatgcccccaaaacagcatgaacatcagcacagcttgagcaaaaaaaaaatagaagggaaagtagaatatgatgttacaatgacaatggggtatattatgtccagctttgtagatcacagaattttggcttttatggaacatgagattagaactattagatgacttgaaactaaggagtgacatgatgttatctgttttaaaatggcttcaccaggcatagcagggagaataacaactcccccaggatgtccgtgttctaatccacagaacatgtaaatatattacttcacatagcaagagggattttgtagatgtgattaagttgaggatcctgatatgggaggattatcttgggttatctacatgaacccaatgtaatcataaaggacatcaaaagagagaggtggatcagagtcagagaagaaccatgtgacaaatagagtaagaacaagagcaagagagagagagagagagtgaaagatgctatgcttctggctttgaagatgaaggaaagggccaggagccaaggaatacagggaacctctagaaagtggagaaggcaagagaacagattctctcctagagcctccagaaagaaccaacctgcctacaccctaattttagcccagcgagactcctttcagacctctgaccactggaactgtaaggcaatgcatgtgatgttttaagctaaattgatggtaatttgttacagcagcaataggaaactaatacagcaggctgcgctgttgagaataaccgggagcaagaacggaagcagagagacctgctagagagctactacagtaacccagaagggagagaatgatggatccaaccaaaagaggggctgtggggttagtgagaaatggacaaattttggcaatattttgaagaccatactgatagaatttcctaaaagcccgcctgtgaggtaggtgagaaagagttaaggctggcaccagggttctaagcctgagcactgacagagagttgctatcaaatgagacagggacaacggcaagaggacctcatttatggaaaaagaaccaatgatccctcttctctgtgacatttataggatttaattattttatttgacatttattagatagtcatccatgtcctcatctgcctttgtggctagattataagcttggagatcgctatttttttctgtgtttttctacatttttagcttaagaactttgttaagtacaaaattatgcaagaataaaagggtggctatccaacctatgaccaaaacacaataatggtacaacttttgaataaaatctgcttttaacaaaaggaatatctgcagtcagagaaaacaccaaatttctatgttctttagttctccaaagcacctaccacagctcctaataaagaatagccgttcagtaggccttggttaaaacacacacacacacacacacagacacacacacacacacacacacacacacgcacccctgtaataatgacttacatcatcagttctgcttgagttttccaagaaaagggattgagagaaagaaagtaaagcacttcttgatctattcatgagaattttaccatttaatttgagattttctcttaccctcatggaaaaatagaaataaacatcaccctatcatccaagcgtcagacagtaaaactgtttgaacttgaaactcatgatgcatttcaagttcaaacagttttactgtctgaagcttggatgatagggtgatgtatatatctatttctaccctaaataaggaaagctgcaactttttttctgtctactgcactaaatgctagttccctgcaacaaagtcagtagtctactccaataaagcagtactgaatataaacaaatataagtaagtgttgttactacatccccgttcacatttaatctgttaccccttcctggccattaggaaaactttatgtgaacaaaggatatggtggtttctagcagtgaattttttttttttttttttttttttttttgagacagggtcttgttctatcacccaggctggagtgctgtggtgcaatttcggctcaccagaacctttacctcctgattcaggcgattctcgtgcctcagcctcccaagtacctgggactgcaggcccacaacaccacacccggctaattttttatattttcagtaaagatggggtttcaccatgttggccaggctggtttcgaattcctgacctcaggtgatcctgacctcaggcccacctcagcctcccaaagtgctgggattactggtgtgagccaccatgcccaactgaaaattttaatctatatatgataatggatctgacttcaggaataatcaaaataaacacctatttgaggagatattctctgctattactttggtcttaatattgctagtgtcttttcatttaagattatccaatataaagtaagcattaatagcctatttaaaaagccagacttaaataaatggtattggttcaagacagccattttgaaaaagaagaatttgactcaacacttcaaattatacactagaataaactcctgatgaaccagaagaaaacaaataaatagaatcaaacaagtgctaaagaaaacatgaacgaattcctttgtcaactggataaagggaaaaacatttctaactaagactaacattccacaggcaataacgaagaggattaaaatattctactacattaaaattttaaaaaacactttgcataaaaattaagcaaaacaaaatacaaatgaaaacctggaagaaatagtttggacttcaccaaaagtaaaacattctctttttgaaagacacttcaagaaaatctaaagtcaagccatgacagactgagagcagtatttatattatttgataatgaacttgtatgttgaatatataataaacccaattcaaaaataaaaaacactttttttttaaaatgagaaaatataatttgaacagaaacagacattttaccaacatagtaggtaccacctaaacattttcactgtgggaatagactagtcttgaacactagatttcaagaaaaatactttataattgaagttattaatcattgttaattcccatttagcttgttcatatattataattccaaagagtttcttgatgtctttattgccatcaaaagatacacaaacttatcaaaagaatttataggagatcctagctaataatattactctaccatgacatctttagagattaatgtataattaaaattaggaatttaaaattgaaaattataattcctgaagcgagagagaccaatgtaacttacgtctaaagtagagccatcccaattaaattcttcagtaatgagattgttaaaaccaattcatcaagaacaaacagctatttccaatatgactgggagaaaaataatttcgttagctttattgatagacattagaagacagctatggctacaactgaccatagaatagaaaagagtttctcataattagcgttaaatctaacccatcataattttttcaggacataggaaagtgcctcatttgaaaatctgggggtgatttcaatctttaaagtatttacttagtgagttagaaaaaaggggaaatgtctatgccaatttaaagaaattttctccattattcattacattaataagtgcatattgaatctctttgcatgtggaagaatagagagtaaacgagtaataaaataaatgcagtccgggtgcggtggctcacgcctgtaatcccagcactttgggagaccgaggcggacggatcacctgaggtcaggagtttgagaccagcctggctaacatggcgaaacatcttttctactaaaaatacaaaaaagtagccttgtggcgcaggcctgtaatcccagctactcgggaggctgaggcaggagaatcgcttgaacccaggaggcggaggtttcagtgagccaagatcgtgccattgcactccagctggagacaacaagagcgaaactccatctcaaaaataaataaataaatacagaatttccaagtgttatagaggcaaggaagtgaagaatccagcatgaaagagaaaagtgttaatgataattcaatgatatatccaaagggctaagtcataaggcagcaaaagttttaatgcacttgaagaatgaacaggagaacggtagaaaatagtgaaagacaataatagcaaaacattggcaaatataacattaattgagttcccgttgggctcaaattacttttttaagtccttaacatatagtaacacatgtaattgtcacaataactctgcttattacttacttattatccctattttacagagaaggatattgaaaaagatatagttgaactaatttgtcaaagtcacacaactaattagtagcaaacagatcctaacctaatctgtctctctataaaaatgaattctaaagataagtggctgctaaattatgaaggaatatgtaggccaaggttgcatttagataagcaacatgagtaagttacatgattctgttcatgttacaaaatatttgcatatataaattgtatttatataattaacagtaatttgagagtaacatacattttataagcttaaaattggaaatggattctggaattctttgtcatcataacaattttttttaaatctttgtttttagaaccaggagctaaacattcatatttaatgtacgcgcctggaaattggaacgtcccccaccctccaggatcttgagaaatcctattgggaaaaatattaagaaatatggtaaaataaagattagtgtttttatttgaaggataaggatgcttgtctaaaaccaacttaaaatgataggaagtctataaaaagcaaagcccagcagataaacctacttgaaaatcttatttccatgacaacagaaacagagcattaaagggccagcacacttctgcaatgtgttgttgttgaaacattcagtcaaataaaacattttcaataaaaggaataacctttcatatccatgctaaattataactacatattaacataggaaaaaatgttagcctgttttataacataacatttttataaatggagggattataaggctgatttttaaaattatcatgaagagatttaacatcttttctactgattctgaaaaacggagaagtaaaatataagatatgatctgacattgcttacagaaaatgagttttctagtttccatagctgtcattccatttattgttttagaaacatccagttcatcatattattttaagataatatagggtgctccttcatgaatatacatgtagccaaaataattttttcatttaaaagaatcactattatttaatgatgtgagatagatttacattcataattctgggtattaaaatttagttctttttggtgttgcatagataaaacatttaaaaatattttgaaaaagatagcttttttaatttccctatggtaacagcaatttttttgtacagaattcctttttcctattatgtttttaaggcttcctaaatttaaatgattctccaaaagcaaatttagcattaacgtatgtaaaataattttgactctgctattttaaacaatatatatattacagattttaaaggtgttactatgtaaatgactttggccctcataacaatcctgtgtagtgaggaaagggcagatactgttatcagttttttttaacaagtgaggtatttgatgctcacacacattacatggtaagtggccataggaaaaataaacaggctggccatgttggttcacacttgtgatcccaacactgaggcgggagacgtgcttgagtccaggagtttgagaccagcctgggcaacatagggatatcttgtctctacaaaaaataaaaattagctgaacatggtgacacacacctccagccaccctgaaggctgagcctaggagttcaatgcttcagtgagccttgaccttcatgctactgtgctccagcgtgagtgattgagtgagatcctgtgtctaaaaaaatttaaaaaacagagagaataaacatagttctttacatttccatggccatcttttttctgctctatgatgctatataccacagttaatttagaagattaaatattgaccttataggtcaatttagttatactttaatatgaattgaattaatggctctatggagaaaagaaaaaagaaagcattattaatcccaatccttgcttacctaattataaaaatgataattccttattaataattgatgcataatttttctttaattttatatatgtaaaatatataaattacatatatattttctgtataaacacattacatattttatatgtatatatatgtatgtaggtagttaggtagatatagcaaacttcaagcaggaaatctttcagggatatacccaatctctgaatttctaaactaaagaggtctattgatctatacccatgagcacaaggaaaatatttgcttgccaaaaagaagaagcaggatttcctagatgaagagcatgtaagaaaatacagaatataaacactaatttcacctaaaatagggaggaatttacaaaaaatatcattaactttggtttctccaatataaatgtctttccttttacattcatttttttcttgacaggaacatgcttaagctaaatgtaaatctactgaacagaggcccctgccttcagagcacaaaacaatgaggaggcaagttcactgcatctgaccatctcatttgtaatcctagttccatgactgaaatgccgagtgaccctcatgaacttatttaaacctactgggtttctgtttcaacacatttattcaggtctttggcagatatgtgagccataaatcctactctgaaggagtttgggacccaggcgagcttcataggcaggcaacctgtggagctgaactaggtgctatgcttagaagaaaccaccacttggtttgatgttctgctgtcatcgtcttgaaaatcttaatttttgtacaagggtcccacattttcattttatactgaggccaaaattatgtagccacttcttgagataatcgcttagaagcaatttcccttgtaaaataaggtgactggatacagtcatgactaatgacgactcccttcttgataaaaatttagacaggcttctctgggccctccctttgaggatgcctcatccttgtgctccgttctcaatctggttagcctagttttagcaggcatcctgataaatcagtccggagagaatccaccccacctttgctatctgcaagttcctcatcccccacctttgatacataagtccttagctacaattagcagctacccttaatgtctcttcttggtaatttctcatccactgaccacatcactctgctccttggctgtaaatcccaagttctctttgttgtatccagagttgagcctaatctctcttcactatggcaatagtcttgatcctcattgcaaaagcttttaataaaaccttcaatgccattttaacaaatgtcaaaataatttgtctttaacatgagaaatataaaattgtgagtttatgttcctttttctgaacaaaaccctcacctcaaacacagatgtcatgagatctccaatgttagttgagaagacaaggcagtctttccaattccttctgccacaagactgaattatctcaaacctgctttactctctgtcaacaatacatttattccaacggtgacatggttccttgtcactgtatgaaaccaaggatatgaaatatcctcctaggtcttcttttgattttggtcttctgttgatttgttcattttaggtttcaataatagaacagtgttgttctctctatgcagattatagatgcctattctcacacataaaactattgcatgtttgcttttctttcattctttaaaatccaatattattagagctcaggaagaccttagtgatcattgtccaactttctgactctacaaatgatgaaaagaaggttaaagaagtcttgtagcttaaacaaaaaccaagttttctaaaattaattaagaattcctccaatgcctcttagctttcttttaaataattatgtcagatttccttatcactgtcaagattttaaaagtatctcttgggttccaggtattgaatttattttctttaaaactctgtttagacaattgctacttcctaagaagagggatgaagaggggcgtaggtgataaatatgttaagcacttttttcagctataatggctagagaaaggagctgtattatattttgcataatatttgcatttgtttttgacctataccagcttaattcagctctcttctttttctaaagtcagctaacacctttaataattccattttcttgacttactgctttaaaattgactacaaaaaaagagaaacatatttttattttgtgatagtagtcaattaaaaatattttattagttaattacaaaaactgtgtgttttcctaaaattttctttcctagtggtggatctatgtaaatgagatataggattttgtttccaacagcttctcagcatagagtttataattacgataaatacacacaagttgccatagtagacaatggtgtgacccacgttattaacttggaatgtaaattttttacttacagggataacatgaggttcctagcattgatttcgacgtttccctaacagacatggaacccaccattatattatttcacattcttgagtaaaggatacattggattactaacttctcattcttcctaaatgttcacctaacaatgtaggcatctatgcatatatagagttaccgttgtgcttatgagctcatttatccccttactgattataactacatttaaatcttcttgaaacaaggaacagaactaaatatgcaggttccagttcagatttatctttcccctttcctcaccaagaaaatttctcttcttgaaatttctgcaataatttgtagctttctattttcacaatttctacttttagtaatccttatctggaccattacaatcagataccaattaattttcataattcaagagctctcctttttagtattgtcaagacaatcaccataagcaggtatttttcaatcacattattcccatgctaaaaaaccttgactgtctctccattatttgaatgatagaatatatgaatctgcctccaagctgccttcaaatgtaagttgtactataccttttgtcatacttaaaagtagagaaaaaaatgctgtccccaaagtactgaccatgtgttttcactcactgccatttcctctatttcacttttccaaatattagtcaccctcaagttcataacaccctccacccccataagaattgttcttttcaagccctaatgtgtcgtaacatcgtgtctctactctcaattttgcccttagttcattattccagtttgccttatattgaaaacaagagaaagaaactattatttcaataatgctcattttttgtacatataggcttatttgataatctgataaaagctttacaccttctattctatcacccgacaaatgaatatttgaaaacttaccaaattttgtacacgtttttgctgttttatgaggctcaacatgaaatcctattttaagatcctaaaacttcagtttataaacctcttgaatattgaaaagaaacttcaaatattgattcttccctgaaggagtttatagagagaagtccccagagtcactggctaatttatctttgtaacccgaagccaatattccctttgcccaggttgtaaagcctttaacgtgagaggcactctggattaattagataccaagtgagtgattataatttcactttcaaaagaatattatatggtgcaaatttggttacatctgtataacttttaatatgtggaaaaatattattttttcttagcaattaaagaaatgtctataccgaagaataaggtctcctactctatttcactgattctgccaattttcataaatgtgcaaaagctcttataataggattttactcaaaatatcaagaaattgagatatagaatgtagcaattatattaagtactttaataaaaatatacagatcttgctcctgcttattcagtcttcgttaactgtgagatgtgtatctcattgtgacttagtcacaatgaaataatgaagatgagctgtttaatgcatttgtcttacatggcctcattttgaggtcaaaaacaaataagaattttggaatatttttgttgtcaacatgtgctgtataagtaagagccaagaatcaacgaatctccctttttagctcaaacaatactaaaacatatagaaaaagaagtaatgcagaaagttaccaagccaaaaaagtaactcaggctggaagtagaaagcagtttggtgtaataaaggaaaacacatagaatatgccattcaacacatctttgaaactacccactggatggtcctcctttctttcagtctagaaacaaagtttctacttgttcacatgcccattaaagcaaattcctttccttaagatgctcagagtacagtaatttcacttatatgcattattgctttctgctctttctgtgacccagggtcaaccgcagtccaaaaatattaaatggaaaattccagaaacacacaattcataagttttaaatcgtgctgtgttctgagtagtgtaatgaaatcttgcaccttcttattccattctgcctaggacgtgcctccccctttgatcagcctctccatgctgtggatgctgcccaccactcagtcacttagtagccttcctggttatcagatctattgtcacagtatcagtgcttgtgttcaagtcacccttattttacttaataatgacccaaagcacaatagtagtgatgctggcaatttggatacgccaaagagaagccataaaatgcttcctttaagtgaaaagatggaagttctttatttaattaaaaaaagacaaaaattatagttgaggttaagatctatgataaggagacatcttctatccatgaaattgtgaagaaggaaaaaaatttatgctagttttgcttatctcacttcaaactgcaaaagttacagctgtagcacgtgataagtgctttaggatgtaaaagccattaaatttgtggatggaagatgtgaacagaaacgtgctctgatcaacgtcaaccaggtatggcactatcatccactggagggtcttggaatgtatccccacgaataaggggaaactgctatagtttcctaacaaagtacaatgttctgcaaaagatatcaaattctttcattctctcccaagttcatatcttcatttctctttgcctacccttagcccctagctcttttccattgttaattggcaaaaagctcagagttccctttcttgactagttgtcaaaacaccaaggctataatctagtgactctccgcattctagcgctcaagcttttttcttgaacatttgcaataatgtataattttaaatgacagcatattttgtagctgtcttgtcttcctagttttgagaatagcagcccctaatgaaaagccttttccaacataactatctttccatttacctctgaaagtcaacgaaataaaactatttcattccttctgggactcatcagatgacagagttcttaaatgggaggccctagagtttcctttttattttatacctacatttgaaaaatatccaactgtcttacagtgtttaaaatcaatacattaccgaaaattctggaggtaaagagccaaacttagttgtaatagatgcctttagtaatttacccgaaaacagattataatttagagactagagttacacataatgaagatcaaattctggctttaccttgcactaactggtaattttggaaaattataattccattttggtttcaatcctgtacacgtaaaatgagaatattaacaatttgcctacaaccgagcaatgatgttctgaaatttcaagagataatgtatacatcattcttgacacatgtttttagtacacaataataaatactgttatttttaactaacaaacataaatgtctaataaatactattattgatgccataaagcaaatgagctattacaatttttggaatttttaaaaatctccgtgtgcaaataaaaggaagagtaagaaaacagatatatacaatttagattcatatgaggaaaagtgataaattttaattttagattttgttgttgactgattctttaacaaggaaatggtattgaactgcctgaaatttcattgcttgatatttatttctgcatgtgaaatgtattaatttcaaaatatgtaattcattttataaatttgtatagatttaagagtgtaaaaatgtttcttatccagacatataaggtatgtttcctatccaaaggtaagtacagtactaattaatctggtagagaagtgtaataaagacattgtaccaaatattcaattattcaatatccatgtacttcccaattctcccagcccccttttagttgcatggggccttgtgactaattctggccaatggattaacaacagagtacatgtgtgtcacttctaagcaaaagcctggatgataggtatgagaacatggatgctcatctacctttggcgaatgcagtatcgtagaggtttagccaacgtagccaacgtagaggttgacccagtgccttgaatagcaatggaggatcatttgatgatccacactggacatgtagcaccaccaaaaataatccatggacatgttaagtcacaaagatatgggagttaatttgttactgcagcataatctagactgcccagattaacatggaaacggtttcattgacaaaaagatgaaaacagttgtactatactaataatcatttcttcataattgcctttatttttaatatttgccaatcttataacttttatttgataaatatatattggaacttattgtgttgaagctgcttcttccccaaagtaagtcattgtctgatatgaaagagaagacagaaatatttatagtaaaacatagagtgttaaattaattctgaggaaaggaatattggtcctactagatttctgggaagagatattatctcatttgagtctggaagaattggatgtattagacatgtgaggatgagcaagatatggtaatgaaataatggggagtattctgggagagagactagcatgagcaaactcataaatagagaatagtgacttgttgagtatggacggagtaaaggctgtaactaaacaacacagagttgacatccaccctcatgtgcttctataaaaaataacagtaccttcaagaaagttattaaaggaaagatgtgaagagacatggaagctttactcagcacgaaagaagacaaccttctttcattctttccaaattcctgagagatatcaggagaaaaacatgattctaaactctactttagaaccctaagctataaagagagggaacagagacatgcctattagaagtttattacaatcaccaccgtgggatttaataagaaaagaaattagtgtgacaagggagtaacaatggaaatgcaagacagaggaaaaaatggaacattttgtgagtgcagacacaagaagtttaggaaaacaaaatcgtggatgtgagggcaacgggaagagaggagatagaaaccaggatgattaaaggatgacgtcaggaaaaacaaaaataagaccacaaacaggggtggggtgaggcaatttgattttggacttgttggctttgatatactaatacaccatgtgggaagaagataaaagtaggtttggaattcaggaaagagtctgggtgacacatgcctgacagcaaaaatagtctgaactatttcaccataaataatctcaggtggaattttcttagaccccaatatctgtttatctgatgcattgcaagaaatatatatatttgtaaaataaataagtatgtaaatatatatgaaacatatatgtaggaagggcacctacagaatggggatactcattttacatatatattgcatatataaaattgtatgtatttacatttttcgtatgtattatataaatacaatattatatatgtttatatataatttcacatatgatactatatatttatttgtaacataaaatatgtatatctatattatatatgttaaaaactgatttccctatcatgcatgtgttcttcctactttcaacaatttttcttactagaaatattcttcctaggatacagcatatcactgcagcccattctctccttttgcctgacactttgttttctgaagactgtagcctccagctgggcatggtggctcatgcctgtaatcccagcactttgggggaccgaggtgggcagatcacaaggtcaggagtttgagaccagcctggccaacatggtgaaaccccgtctctactaaaaatacaaaaattagctgggtgtggtggcgggcacctgtaatccctttgagaggccaaggtgggcggatcacaaggtcaggaattcgagaccagcctggccaacatggtgaaatcctgtctctactaaaaatacaaaaattagctgagcatggtggtggacgccagtaatcccagctactctggaggctgagggaggagaatcatttgaactcaggaggcagaggttgcagtgggccgagattgtgccattgcactccagcccgggtgacagggtgagactccgtctcaaaaaaaaaaaaaaaaaagactgtagtctccaaatgagtgtccaaacactcttaatgttcaatgagagggaataatattcaggttacattgaagagggaagagtacctagttctctagtgtaaaatggggatcttggaaacagcaactttggagtaaggaggagaaagcctgtcaatctatttcccttcagacccacacagtttgctgcaccaacaggtggcacaatatgcaaatcagttgtgattggcaagtccagttcacgcattatgaaaatataatttgcattccgtgttttgtttggtttgcagttcaataatgaatttaaataattttctattctgtattgcactattatcatcctccattatcacttagtttccagtaaaacctgttttatgcaacagacacatgtcggtggtgccttaagaaacaaaaaaaagaggacagtggccacacactgggtgaagcaatatggaaagaagatgttagccccaggaagtgactggatattaaaagatcagtcagagcaggaattcagagtcagagacaaacacaagaaaataagctcccaggggagggtattgaactccccataatacttggaattggggctttggccatcttactagctgtgaaataaaaggatgagaccagaaagtgaaatcttttcatttttagagtttggcattattcctaggatgtaacagatactccatcagtttggaatgaataaataaataagtggaaatgtgtgagaacctgggggagaaaatattgagagtaaagagaataagaaaaaaaaaggaaattttggaaggcttacatttttaaaaaggagtaatgagaaaatgaactgataagaaccaatggatacttacggagataaatgaatcgccagagaccaaataaagattggctttaaaaatttaagtcttctttcagagcaaagacctatcttcattcttgtttcattcttcattctactgaaaattctaatacatttccactttattggagagggcaaagaaaaagtgaactagccctttattgtgtcatgtttgatctgcattccaagccttttcagtctggaggctcttagagcttatattagtaataagtatttacactcccaaatttgaaaatgtatttggccttatttttaaaaacaaaaggaatggggtttggaaaataatttcagagtaccaatagatagcacttaatttccctcctttgtttaatactctgctgcctttaaaatataaagaggaaagtccttttccatctgctgtcagggaaacaggaaggaaaaaaatcttgaaacttcaatgaaaatgtcaaaatgctaataaaataaaacatttcacacatccttacagcaatatgtaaatcagaaaagatatatcaccttgttcaaagcaacgaatagattatgtaatgtccagcaaaatgtctcaatcgatgcgcaataaatatatttttttcattaacattgtaccccaaatgggtcatccagttattgccaatatcatgcttcttcttagatctaacgtcctctcctttagggaacttgaatcccacaaaaacctgattatacaggactacagaacactattgaatgttacaactgattgcctcattttttctcctattatttataatttaaagaaaaaatttcaaaccattttggttcaaagagattaaaatactttatgaataatttgctgcttctatccttaataactaatacatatttagagtgattatttcaattcaactcaaaaatactattgaaataaggcttttttggcatgatatcaaaaaagattatttaataaaatactctagagctaagtttacaggaaagtactaacaaaagaagctttaggttttcttttattcctttttaccttaactaaaatcttggctaaaatcttgagttgaagcttatcacaatattaaggaagtattaaataatagtgcaacacaaatcagacaataattgggaattcaaacaagttctttttttttttttttttagctttgcaaagccacagaaacaatgagatcaagaagtaagaaaatcaggaaatcttcattactctttacaaagaattaataagattaccagtggagtcgttctatgcttttatgtaaggggttatgttccaaggaattcaaaacaaaaaaggaaaggaaaatacccaacaaataagagttgtggcaacttgagaactcacatgactctgaggttttatttctaagtagtacttttgtgtgaagatattatgatattaatatcactcagttaccaaaaataaaaactttaagccttcttagcaagttcaaacaattgttgtaagcctaaacactcttaactatttcactatcaaagagtatttatacaatatgttttataattgttccacattaatttgaactatagatacccactttaccttgaaactaaatgcaggctgccagttgacttaaatatctcacaaggttaaaacaaagggactcctataaaaggagaaataggaaaaagcacaaggaaagcacatttctgacttgggcaggtaaactgaaatttttgaaagttctgaggatatagttttgattttagcagaggcactttggaaataaatatgtgtcagcacaagatagcagaagataagtgtatctagaataaagatactgacaccatcaatttcttaggaaaagaataaaaggcaaacaaataagaagaaacagtaagaaagtaaggatatgaggacagagtagaggtgtttcatccagaaattacatgaaggctcgaactaaaagaggaataaagtcagagtctgtttcatcaagaactctttttatctgatagcaatgaaagcttagaaaggtgaaaatcctaggactcaagagaaaaaaataatctaatgaatgactggtggatggactattacttcaggccaagattgaataactaggactggatttacctttatacctgaaacaacaaaagattgaacaaaatgtatgaaacaattgtttccaagacaaagggcagtatgtaataaaatacaaagatctctgaaagagggaatacaaatgaaatgagccctataattgccttgttactgccctgaaggaatttccaggcagtggtgcaaaaaagaaaaacccaggcagagtgctgaactccgtgagttgaaagattgaacggagaatacggagagacctagacagcagcagttaaaagaacagagtagccgagggaatagagctgcacaaagagagaagtgtggagatccacagagggtttgccttcagtatttagcagagcactgattcacaaatgcacataaagaaacctcaagaaagaaccacctgaaaggattaaaaggaatagcaccagttgctcacacagagctagaaatagtagtgtttgtttctaccagtaagggtagaacatctcataattctcaagtcacagggtagacattgagaagagttttgcctcagtagttaaaataatttgacaaaacactgctctggtcccaaccaacaaacttaaaaggaatctttgaaaagattacattatatccaagtaattaactgcatcctggaacatagttccacagtattttttctaaaaaagaaaaatttcaaaatttctagcaggcaatcaaaaattactatgcatacaatgaagtaggaaaatatactctcaaaaagaaagaaaataatctctccaaacagaaccagatctcaactaaatatgatagttagcaggcaataatattaaaacagttattacaactatagtccaaatgttcaaaagttcagtttgcatttgcaaaacttataaaactttatgacacaaacagtacaacaaatgtatgcaaataatatattaggacagaggatcccaggaaagaatgcagactgttacaagagaatctaactgtattacaaatgtatgaaaaaaacttaagaggttgagagtaaggtgctgaacgaaataactgtggaaatgaatggtgtctatgagacataaggcaaaaggaactgaacataagcactctattctagtcaacaaaattgttttctactggggtagaggataacaattctaatagtactagattaatgtactggaattgaacaattaagtaaatagatgacagatgatgcaattgaggcttctcactattggagtggaaatttataaatcagcaagggaaggaggctagaatgatccatttggtaatggattagagttgaagatttaagaacttatgttaatataatactgatgattacacatggaaatatttgtaaatatgtacatattataggttaatatacacatatatatttcttttctctctcaactgagaggaagcaatgacactccggcaacaatgaaaacacctaactagcaaacaggagcacgtaagagcctagcgctcgctcttgctttttaataccactcaccaacagaaggaaacagagatcattggacaaatgactgattctaggactgggatgagatataaacaagataaatctggaacatcttttagttcaagaaaaaaggaattattcaaaaaaggaaagatatattgataaattaatgtttatgtggttttcctgggtaaaagggattttttaaggtaaaaaactaagaaaaatcactgggtaaaaaactaagacagtcagagtaaaatatgcagtttgattaaaaacaaagtattacttcattaattataacaaatataccgtactgagatgggagagttcccttgattcctttgtgggacttgcaacagggtgtgactcctttactcagcccctggctcatttgctcaaactgcttgtgggagggggagcacataggtgagtgggtgcaggagccatggcaagtgcttttgggcaccagcaggaaagaaccccataccagcgcgcagcagcatctaggggttgcccacgacctctggagccccagagggcatgtgttacaaacagtttttgctttgctgtctgctgatggcttaagtgtcaaacagctcagtgaagagtcagtatgatagcctttttgggttcctgcacacagtgcatcccaaattcttatccagcatccaggaagaatcaggttacatgaacggattgaaggttggtgtatgcagaggatttttactgagcgatggaagcaggatggggacctggaaaggggatggagtgggaagataatcttcgcctggagttcggccattcccagttgaactcctctcaacattcagatgcttcttctcttctctcctctgctgtaccgctctgctcctctgccagtggaacttggggtttttatgggtacagagttgggggcatgggaggtcagagtggttttggagggggcatggcaggccagggttgttttgtaaaaggtagcattcgggcaggaaaacaggaatgcatattcttatttagggcctgaggtccaggcttgtgggtggagccctcacccaggaccctgccctcttctacccagtatttccctgcttcctgtctgtatcaatacttatgtaagatgctaataataggggaaactatgtgtaaatagtatggcaattctctgtactatcttctcaatttttctataaacttaaagctgttgtaaaaattaacataaatattttaaaatgtaattgattcaataaacaaaaataagcacaagcaattatatcacaagcaatatatagcatgtgatatacaaatatgtgaaaagtaaaatgtatgagtacagaatatttcagtacaatacatttcagtactgactgagaggagagaaatgaagcaaagaattacaagattcttacaatatatgtgaagaagtacaaaaccacttgaaggtagattctgataagttaaaatatataaacattaaaatatccaggacaataacaaagtagttatagctaacaagcatagaaaagatataaaatgcaagcataaaaatcaattaaaaacaggaagtgaaaatggaacaaagaagaaataaacacaaaattaaaatagcaaaatgacagatgtaaacctaaccatatcagtaataacattagatgcacgtggtctgaattccgtaatactttcaggaaaagccatttgagggaatgcaatatccattgttgtttttagaaactctctgcaaatttggaataaaaagaaactctctcaagctgataaagattttctgaaaaaaagaaaaaaaaagctaaatctaacaccatacttaatgataaaagactgattgttttccacctaagatcagaaacaaaacaaggatgtttgcctttaccacgtatattcatgaatatactagaggttctaaatagtggaagaaagattaaaaaaatagcaacctatgtttttgcagatgccaattagaaataattagaaattgaaattttaaaaataccatttataatagcatcaaaaaacttaaaatatgtagggataaatctgaaaaaaatggtctagaaccacacacttgaaaactacaaactattgccaagagaaattaaagacttagatcactggagaggtaggctatgtaaataggtcggccaaagatttaagcaaacatttcaccaaataaatatatgaatggtaaatgagcatataaatagagctcaacattataagttattaaggaaatgaatattaaaatcacaatgtgacatcgctacacacttattagaaaagctaaaaagggttggacgctgcggctcttgcctgtaatcccagcactttgagaggccgaggtgagcagatcgcctgaggtcaggagtttgacaccagcttggccaacacaaagaaaccccgtctctactaaaaatacaaaaattagctgggtgtggtggtgggtgcctataatctcagctactcgggaggctgaggcaggataatcgcttgaacccaggaggaggaggttgcagtgatctgagaccatgctgttgcactccagcctgggcgacagagagaaactctgtttcaaaaaaaaaaaaaagaaaagctaaagaaaggtgaacataaccaagtgctggtgaggacatgaaggaagtggaactttcaaacactgctggtggaaatgcaaaatggtaaaagaaactttggaaaacatttaggaaatttattgaaacttaaaaatatatcaaccatatgatcgatccactccacatctaggtgtatacccaagagaaacgaaggtgtgtgtccatattatgactcttataagaatgtttataacagctttatttgtaagagttaaggactaaaagaaactcaaatgtctatgaacgagtgaacaaataaacaaatctaatatatgcatgaaagggaattctatttgatagtaaaatggaagaaattcttgaaacacactacaatatgatgactcttaaaataattatgctgcaagaaagaagcaaaaaagggtacatactgtatgatttcatttatctgaaattctagaaaatgcaaactaatctatggtgatagaaggaagattagtgattgcctggggatggaaggaggagatggggttgttcaggtagaaagaattcccaagaggcatgaagaaagctgaggaaggatgtatacatgttaaatgtcttaactgtggttatggtttcatggatgtataaatatgttgaaatgtcaaattatacatgtttaatatgtgtagttgttgtatgtcaatcatctttcaataaagctgttaaaaatatgactagtcacaaagaaatatactaaaaaagaaatccaaagaaatttaagttaaacctgcaaaaacttcagaggctggagccttaaagtctgggaatcaatggcgtgtctgtgcatttaagcgacaaagaacaaaaggtagaggcaatgtaatcttctaaattagtgccaaactagttaagcaacacgaaactcagtttgtgtcattcacttttaattcagtataatttgttccatgaaattcctgtcctagagaaaatatatccatacgcttctatgaagtctatgtttactgtgtagcagaagtacagaaaggtgaatgtccttccatgctacagaagcaagagccaaatgaacccagagaaataatatctagacaagattctctccccactccccactcacttgattcctacttcttgttagattcctgacaccaagacagatgtgacaagaatacagatgaagtgccctggggttttcctaaataatatcctatatcatgaaacttcaaacagctaggaactagatgcccccaaaacaaaaccatccatgctgtgcctccaggaatttaaaataaccatgagtagtatgtcaagggctctaatgtaaaaagtaggcaacacaaaatagctgctaaataccaaatatttaaaaaataaactatacatttctaaaggacacatgggtcaaaaatgacattttgagaccattttaaactattttgacataaataaaagtgaatatacaacttattgaaatttatggaatgcagggataggagtgcttagagggaaatttctaactttaaattcatatattaaaaaagaagaaagatctaaaataaataaactaagctgttgtcttgagacactagaaaaagaagagccaattaagcccaacacaagcagaagtgagaagataacaatacaagtaaaagtaaatgaaattgaaaagagtgaaacaatagagaaaaatcaatgaaactgaaagctgagtctttgaaaaaaaaatcgataaaattaacaaactttagccatctgattaagaacaaaagaaggaaaatacacaaattaccaatattagaaattaaggagggatcatcactactgaggctatgaacattaaaagaatatactagattctatgaacaattctatgccctcaaagttgataacttagataaaatggaccaattccatgaaagacacaaattaccaaaattcactcaaggagacataggcaatctgaatagcactatatttgttagagaaattgaatccataatttaaaatattccaaaagcaaagatgagagggaagcgtagcacagaatgaaaatatctctagaagccaaatattatggtctatgctgtcaatttatactgaccattttcctattagttacttcggtgacaagcaagcagaacccccagcttaaacaccaacagtaaagatcactcatcacttcatggcctcttcctcccatgcagtgcctctaggagtagaaccaggaaaatctttccttaatggtcagctactatgtttaagcagatggctattttttggccatgagtatttcaatccttttgagaggaaagttaagtgaatgttaaggctactctttatgtgtaaagcatatggtgaattctaggaaaaatatctcatttcctagaaatttcctcacataaatatctcatccatgtgaaaaggcctgtaacaaaaaaaaacactaggccagagaacagcaccaactttcttcattaatctgtatcatcctaaatgaatttagatccatgaaaataagcatttccaaaagttgctaataacatgcatatataaaacaggaatataatggaatcctctagcatggtcaaaggatatttcaagtttactctttataaagaaattaaaggcacaaatacaatattggagcttgtataaggtgagtgaaagagagaaaagacaaatacatatgaattataaatatatatttagataaaggataaaaatacaaaaataaggataaaaagggcaaataaaggataaataaaaaggataaaaatataaaaataactttatatataaattatatagctacgcatctataactctagtcctctctcatttaaatgactcagagaaacaagttcaataattttaattcaaactaaaaaaaaaaacaactttgaatcagatatatactggccaggcacagtggttcatgcttgtaatccaagcaatttcagaagccgaggcaggcaaatcacttgaggtcaagagtttgagaccagcctgggcaacatggcaaaactccatctccactaaaaatacaaaaattaactgtacgtggtggcccacactgtaatcccagttactggggaggctgaggcatgagaatcacttgaatctggaaggcagagattacagtgagccaagatggtaccatgcactccaggctgggtgagagagagaaagagactctgaaaaaaaaaaaaaaaaaaaagaacatgtatacataaatctgattgctagaggtgagtttaaagacattttatttttcactatccctaatataaatttaaggttgttttccaaatttataatgtattatatcttctataaaatagaaataaaataaataactagatggaggaataaataagatgaaagtagcatattttctataaaaaagtattaaatattcacatgtttactctgttaatctaaaattaccatttgtaactgacatagcgtgtacattaattcaaggcagaattcacagttttacatttttaagtcttcctatccaaagcatagttttgtatttatgtctaatttataacttccatagattaactttttggctgaggctataagttcccttaaaaactttttcataagtctctcatacatagagaaaagtgtgcactttgcaagagtaaagcccagtgaattttcacaagctgcatatatccatgtaaacagcacccagattatttcagtgccagatgactctgccagaccccttgaggtcacccctttccatcaagggtaaccgtccctgtcttctaacagtatagtagtagactccctgtttctggattttatagaaactgaatcatacactattaatacattctttttaatttatttttgctcaacattatgtttgtgagatctgtccctgtagttataggtcatttattcttgctgctgagcagtgttctcattgtgttaatttagaacaatttattaatccaatctattgctgtgaacatctatatactttctggtattgactattaaagacagtgctgtttgaactttcttgtacaagtactttcgtaaacaatacacacattgctttggagcacgtggcaatgttcagctttagtaaccaatctaaatccccatcagtattacattagcattccatttactcaaagcacaaggttttatgtttttgtctttttttttttcttttctatgagtctccattttcattcgagcaattctggcaggtatatccagtgaatatttcatgcaaattttgcatttaaaaaataaattttatgtctcgtgttgaaagctttggttgctgttgcgaatagggtcatctcagctttgtgtttttccaaagtcactggaccaattatacccgcaccatgaatatcagcatgtgagtttttgcaaatacgattttctgtttgtcatctttctctctacacctcatctcctctctctctcttccttccttttctccatttcactgattctggtgattgtattgagtagacatttttgagagctgtattaaaggttaattgaaatacaataatctgcataaattcaaagtataaaatttcatgagacttcaaatgtgtatgcatatattaaaaaatcaccacactatagataacatttccatcacacccttccaagtttcctcatgcctctttgtgatccatagtttcctccatatcataccccggcagcacgagatctcttctttgacattactgtttagtttgcattgtctagaattttatataaataaaatcctatactatgcatagtttttgtggatttttttcactcagtataattattttaaaatttatcaatgacactgtacatatcaacaatccattactttttattggtgaatagtattccattgaactaatacgccacaatatgtttatcaattcatttattaatggactttgtttttttttagttttgggatgatacaaataaagaggctgtaaacacttgtttatgagtcttggcgtgagcatatgccttcacatttttcttgaatcaatatccaggagtgacattactggtttatgaaagcacatgtttaatttcataagaaacttcaaaattattttccaaaattgaacaaatttatgttgccaccagcaatgtataaaagttccattttcttggccaggcacagtggctcacatctgtaatcccaatactttgggatgccgaggtgggaggactcttcgagcccaagagttcaagaccagcctggccaacaaagtgaaaccctgtctctagagaaaataaaaaattagtcagctgtggtggcagatgcctgtaatcccacctattggggaggctgaggcgggaggatcccttgagtccaggaattctaggctgcagtgagctgtggttgcaccactgcactccagcctggacaacagagagagaccctgtctccgaaaaaaaaagaaaaaaaaattccattttatcaataccattgccaacatgctgtgctgagactttttaaatgttgaccttctagtgggtttacagagatactcattgtggtttacatttgcatttccctaataaaataaagttgagcaagttttcatgtgccatttgtttttgtttttgttgtttgagaaagggcctgactgtggcccaggttgtaatgaagtggcacggtaatggctcactgcagccttgaccttctgggcttagatgatcctcctatgtcagcctcccaagtagctgagactacaggagcatgtcaccatgctcagttaattttttgtattttttgtagagacagggtttcaccagtttgcccaagctagcctcaaactcctggactcaagcagtctgcccacatttgcctccaacttccaaagtgctgggattacaggcatgggctaccatgcccagctttttgctaatttttgagtagggttgtttttcttctcattgatgggttgtaagggttcttctactatcctggatacaacttttttaataaaaatttacaaatatgttttctatggccaaacttttcactacttcaagtgtcctttgaacagcaaacatttttaaattcgattaattccatttcattatattttgttttatagtttgtgtctttgtgggggcatactattcatgtaatctttgcctaattcaagatcactgagattttcttctgcgttttcttctagaaatttctatttggtgttctttatacctataattttcatttttttatttcatttttttcttttttcttcttttcttttttttctttcacccagactggagtgcagtggtgtgatctcggctcactgcaacctctgcacctaggctcaagcaattctcctgcctcagcctccccagcagctgcagctgggattacaggcacaccactaccaccgggctaatttttgtatttttagtagaggcagggtttcaccatgttggccaggatggccttgaactcatgacctcaaatgagccacctgcctcggcctcccaaagtgctgggattacaggcgtgagtcactgtgcctggtctcattttttttatatagtatgaggtaataatgaaagagtacttttttgcatgtggatatcgttttagcacaattgttaaaaagatgatcatttcactattgaattaccttgaaaacactgttgaaaatcaactggctatatagatgtggttccatccctgggctctctagtgttctccactgttctgtattctaacattatggcaataccaagtgccttgattaatgataagtattgttgtcagatagtgtaaattacctaattatgctcttctttttcacaattgttttagctattctaggtcatttggatttttgtgtaaatttaagaatgagttagaatatttctacaaaaaatctgagtgggttcttgattggtatttcattgaatctatagatcaatttgaagagaatgaacatcttaacaatattgagttttccaatccatgaacatgatatatttcttcatttacttagttcttctttactttctttcataaatcttttatctttctacatgcacatcttaaatatttttgtcaaatttatccattaacatttcatattttgtgatgctattacaattggtagtttttgagactttttttcttacttttaatttctgattgtatttgctggcatatagaatatttttgtctattctgctgaggaatatttgtctgtagttttatttctttggattttctttgattttgttatcagtagaagagtgatttgataggaaaccactattaaaaaaaacagtttgtgtggaactggcgttacatcctccttaaatatttggcagaattcaccactgaaaccatttgaacctagaattttcattgtggaaaaatttttaattgaaaactcaatttctttaatagctatagtgctattacaatttatatgttttcttcagtgaactttagtagtttaagtctttcacagaatttaaaatgttatccaagttatttaatctattgccataatgtttgcaatattcatttttaacaactatattttagagtggttttaaattcccaggcaaattaaaaggaaggtacagagatttccccttatgccgacacatgcatagcctcccccactatcaacatttcccaccagaatggcatgctcattacaactgatgagcccacattaacacatcataatcatccaaagtccatagtttgccttagggtttgctcttggtgtggcacatgttaagatttggacaaatgtataaagacacatacctatcgttagagtatcatacagagcattttcactgcctcgaaaatcctctgtgctccacctctccatccctcaacccctgacaacaaagatatttttactatcaccattctgccttttccagaatgtcatatagttagaatcatggagtatgtagcctttacaaattggcttcttatacataattatatacatttaaggattccccgtgtttttgcatggcttgatggtttatttctttttagtaatgaataatatttaattgtctggatgtaccaggtttgttaatccattcacctactaaggaacatcttggttgctttcaaattttggaaattaaggataaagctgctataaagatccatgtgcatgattttgtgtagacatgttcccaacttctttgggaaaatatcaaggagtgtgactgctgaatcataagacagaagcatgtttacttttgtaagaaaccaccaaactgtcttccaaagcggttataccattttgcattcccaccagcaatgaatgagtgttttggatgctccatatcttcatctgcatttggtgttgtcagtattccagattttggacattctaccaggtatgcattgttgttttaatactcatttccctgatgacatgaagtgtagagcatattttcataagcttattttccatctgcataccttatttgataaggggtctgttaaggtctttggcctactttttaacggggatttttaaatttcttcctgtcgagttttaagagtccttggtgtatttcaggtaacagtcattggatatatcatttgcaaatattttctctcaatgtgtggcttgtcttctctttctcttgacgttgtctttcacagggcagaagtttttaattttaataaaccccagtttatcgtttgtttctttcataaattgcgccttcaatgttgaacctaaaaagtcatcaccatacccaaggtaatctagtttttcttctcatgttattttccaggattattatagctttgcacttaacatttaggtctgtgatccagtttgagttcgtttttgtgaataatgtaagatctgtgcctagattgttttacctagggatgtacagttgttccagcacatttgttgaaaaaaaaaatctttgctccattatattgcctttgctcctttgttcaaatatagttgacagtatttatgtggggctatttctgggctctctattctgttccattaaactatttgttgccattgatctatttctatttccatagatctactgatctattctttagccaatattgcattgtcttgattagtgttgcattgtagtaagtgttgaagtcaggggtcagtcctgcagttttattcttttccttcaaagtgatgtattggctattgtggtttgtattttccttatcccacatgaaaggctacagccgattgaagtggggtatttcccttcccccagatcagttaggttctgatcatatcccagcacatttggttctggttaaatagtttctccttaggaaatatcttgttaagaacaaagtgctctcatgtatttcaaaatggttcattttcccctctccctgccagaagagcaatggaatttttctctgatatttactgtgggaaccaggtccatctggttgaacttgtgaaggtgaatattgtgccttgtccccgtgactcggtttctctcgagcttttggtccccagagttgtccacatcaagcctccagcaatttgttcaggttttcttatcctcatgagtctttgatctggcaagactaactccctgctttcacctgtctgtctctccagtgttggaggcaacagtttgccctgtgtcatctagatccagagtgttgatttttcaatctgttcagcttgttatttgttgttaggaagtaatggtgatttccaaactccttacatgtggaactggaacccagtcctttattgttattttaatgtctgtagtatctgtagtgaaacaccctttgtcagtcctgttttctatgtcattaacttgttttggaaaattcttccttcactaattcgttattctcaatttatgcacttaatgctataaagttccctctaagtagagctttacctgcatccgacacattttgacaaatgtttttcttttcattcaatttcaaattgtttcaatttttttcttgtattttccttaatttgttattcaaaaatatgttgagatcagtttccaaatgtttgaggattttccagttatctttctgttacggattgctaatttaattttgtttcatgcaggaacatgttatgtatcatttcaatcatttcaaatatactgtgacttattttatggtccagaatatgacctgcctgttatatctcattattactcagtaacaatttttgtaaatgttgaatccttacttgatgaaagaatgaatgaatgatccacttctctggaagtttcattcatccttttctgttctcatttgttgcatgacttcaggaaagtgtcagttcagcttgatcttgtgctattgatgacttactattgtacaattgcttgtattattgatgacttgagttggtctacactaattcctaggtacctttcagtttcacatgctgtgattacatttcaataaatgcatagtattctaaatgctgattccaggcatttgacttgacttagtcactaatgacttacttcgaaacaccatcatgcctaacaaaatcacaaacaattacatttcacagatttccaaagctactctcaatttgtcaaaaatctcgctattcaaacccataaatgccaatggcttattgtattttcatcttaccttttatctatgcattttttcacagttgtaatcatactttatacagattatatgaaataaagtatatcttgtttattttcctaatattatgttgatctgctagctaaatgtaaatgacttcaaaagtcttttctttataataatatgtgattctgtgtataggacacacaaaataaaaagggagcacatatacccaggaagtaagttaatcacttacagatatatcacatttatttatttaaaaaaaaacaacaaaactacatctgggcatggtggctcacgtctgtaatcccagcactttgggaggccgaggagggcagatcatgaggtcaggagttccagaccagcctgaccaacatggttaaaccttgtctctactaacaatacaaaaattatctgggcatggtggtgcgcacctgtagtctcaactattcaggaggctgaggtaggagaatcgcttgaacccaggaggcataggttgcagtgagccgagatcatgccactgcactccagcctgggtgacagaacaagactccgtctcaaaaaaaacaaaaacaaaaacaaacaaaaaaaaatactaacagagcacttactttgtgccaagtatttttctaaacaattcacaagttctagaccttttacttttaatcttcctaccaagtctatgatgcaagtacaatcattacctccatttacaagtgaggaaatagtataggctttaaaaaaattacacaaggtcacatagctaataatttgcagcactgggatttgaacccaagctatctggttccagattctgtgctctgacttattcatctccatgattaggcatgttatttactttcttttattcaccaattaattaacaaactgaattgccatagtagtatagtgtgattagtgctataattccaaataatatacaacactttgatgtgttttgtcattgaccttaattattagtttccttgagccagaatacagcatctaaacttcactttaaaatacaagatctgcttttttcttgaaccaagtcaaatttttttttcaatttttttcagggcagtaattcaattcctcaaatatcaaacaacaatgcattattaaaaagtccctgtgtaagtaagctatcctaagccctttaattcagcatcttaggctaccttgttgacactgaacattcaaccatcaggtttcctttattcactcaaaatgttattacgtacctactatgtgacaggcactatgccaaatacagaggatacaacaataaaaataatgtatataaaatatttatttttgcaattaaaagcttcttaagtttttactttacattctaaatctcatggctctccttatggactgctatctagaaccctgagaatttcctcttttaaatatattctcttacactacatcgcttctctcctttaacttctccttgttcccacaccctatgtcatggtgaaaatttgctctttgggaaaactatctctcttttcttctgtgtataactctgtttcctagggttctcctatggttagacagctaagttgggagcctgtttcccttattaactagctttaatcctgaacaactactttggtctttcaaagcctcgaagtcctctctataaaacagggattagaagaagtatctttttaaagagatgttgtaagaatgaaataaaagcacccatcacacaaaacatttatgacaaacaaataggaaagattcaataaatgtgagtacctattattattatcttaatcatgttaatatcatatttctagggcatctttagaaccattcatcttcttaatcccatgcctcctgcttggtttatttgtatgctagagtattctggtgcttctccagtctttccttatttatctttctcactttatctttaccttgagcaaacagttcgaaccaaaattttggaatttttgtcttcaaaagaattcagtctgccaggcgcagtggctcaggcctgtaatcccagcactttgggttgctgaggcagacgcatcacctgaggtcaggagctcgagaccagcctggcccaacatggcgaaaccccatcgctactaaaaatacaaaaattagccggatgtggtagtggatgcctgtaattcaagctacttggaaagctgaggcaggagaatcacttgaacccaggaagcggaggttgcagtgatccgagattgcaccactgcactccagcctgggcgacagagtaagactccatctcaaaaaaaataaaaataaagaaagaattcaatcttactaacaagtagctgcctttcctcctgatttctgaatatttttcagccttccctttaaccctggtcacaatagctttctctcttttctactcattaccttgattctcaagtaatgacactatcccctatattcattcaccaacacaacatttttggcttattctgacttcttctatcccagggttatctatgctgttacttctcccgtataggaatattgcctatttcagagtctttgtgcaaaattaatagcattatgactctttaaccttggactaatacaatctctagtgaccattttgtatgagaatagctgtgatctgctcgcaatttttgctgcagaaataaaaaattttatttcttttttttccttccagatattcccaaggagatcatagatcattttattactaaagctcaactaacacattatttttatctctgacatatgcattccagagaaaatgtctgactcattccactgggaatttacaattatggcttataaaacacaatctctctatggtttttttcttttcttcacctcagagattccacatatttattattttacttctattggcctttccttctcctcctggctaattagccaagccagcatttgaaatcaatactagaagtaacatgtttttatcttctctcatttttgcacagtttacagaggtctacatttgtcagggtgtggctcatgcctttcagttctacacacctctgcaagctctctggaaccaactctgcaccgtggtgtcaccctgaacacttgtctccacctcctccttcactactctactccagacttacacccttctcctctatttccaggaacttcctaaaattgcttccagggcttctttgatgtgtgtctttctgtctgaggcatcagccatcttggcttcaacccaggacacactaaaatattcctataatgtgggtatgatgagttgccatgcaaattgaagtatgcataactaaggcaaagaaagaaattaagatatttcaaaaggttgtataataaactctctttacttggctttctttgagaattagaagaaacattataaattcctttgatcatagtgaatataatattaataaatactcccatctttaaagttgagttattattttgagtacttacagtaaagtttctccaatgccagcctaggaacccaaggattaatatgtaagcaatgccgaaatttatgtgacaaataaaaggtgcaaagaagttaatgcatttgaagcaataaattaacatgtagacagatggtataacgctcctgtgaaaataaaattctaaaatttacacttctgtgaaaccaaaatgtgatcatcagagttctttctaacaagtcttattaggatgaattaaactatactctctgggtttacagataaatactaattaaccttcataaagggatcaaaagaaatggaattgttcactgggcaagtagatacctgctgattttatttaaggtatttgggggaagaagaataagatattaaataaaataatacaattttatttttatttatctgggtctgtgtgtgttttagctatgttcaattgattagatagatagatatgttaattttcagatgtaatgaaggacaatgtgtgtttttttctcagtttaatgaagtaacataagtaggtcctaaaaaaaatcatttacctggtactcagatttaaatgtcacacacaggcattcctttattacattaagtactttgtcatttctaattttaggtctagaaaatttatcagcaagactgaaagacaagtgccttgtgaaaaaaaaacactgtaaacattttgtattaaatattatttaaattataattacagaaaacaatcacattttcttctatgtgtgaatgttccaagtgcagatgttcacactttaaaaatatgtaatcatttatttgctattcagctatgttattatattttccacaaatcaatgggaaatatattttgataaaaaacatagccaaactataaatagagtaattatgataaatcaaagatttaaaagactggccctgttgttttctcatagacaactaacaattattaatgaattaattttactttttccaaaaaaggcacttaatttctgttacaaaaaactttgttctcccattattttcaggatgcgtaattttaaaatgaatccccaatatttaaaagagataacaatatgtaaaattatctcttggtctcctcactattacagactctcaatatggaaacaaatccaaatatttgtattcaggaagctcagtaaataattgtggttacagtcataaaactttagtgtgtcataaagttatgcttaattatctttgtttatattatagtccatctttctacagacttttattagggtgtctattttcccctgtagtaacttattaatttaacaattattgactgagcacctgtcatatattaaacaaagtaataaaagagtcccataaactccagaaaattgcaatccatagaaaactagagaaaaatacatgactagctagtgtaaaaagaaaatggtaactttcatgaaagagacgtgaggcagcaccagggaaacacggagcaccatattccttacggcaggtggaatctcagccgcacatcttcatgttccgcaggtcaataaagattgtggaataaagaaatagaagtaatgacaaatctaaggatgctatcattgatgagcacccacatgtaatttgttagagaaagaaaaagttccaggagaaatacagaaaacaagaagtcagagacattttaaaaattgaatgtaatgctgcaaaagctgaaaagggaactatttttcaagaaaagacctacagccaacggggttctggacgctcagtgaggctgcagatgggcagaggactgttgatattgggagagttccctggggacttgagagagcaggttcagtactgtggtgtggaggggagggaggagtaaacactgagggagcagagccaaagggtgtggcatatgcttttgaaactttcacagagaaattggagacatttaatggtaccttaaggcgagaaaaaggtcaatggaaggtttttaatatttggaaatgagaaggcgaatagcttaaagtcatgagaaaagagaggctgtaataatgagactgaagacgagaaaggaagtgtatgagatatagaatttccagaaaggtagatggcaccgagaatgagggatccttgatgtgaaatagatggaaaatgggagaagaggaaaatttatacagttcatttcaattggcatacatccttttaattaagccaaggccgtggccatctgcagagaaggaaaatataaaagataactgaacaattgttttctacactgtaccctttcttactgcttaacacgcctcagtttcgttttgtgaagttaccttagccccaaggtgtgtgtgtgtatactgcaacaagaaatctatgtgcctgcctccaattacaaaagctgtagaggataattcgtgcttctcacctcccagtacatccaagaggcagaaatgtgtcctaagcttagacagaaaatttactcctgggactttgaaccttgatgcaagaatactataaggatgggagtctacactgcctagcagctgtgccctgacaggtttctgccgaagaatgattcccacagctcccagtttctggcttctggagctggctttgtcttgtcctcttcatgtctgttcctctattctttttgcaatgccatgagcttttaatatcaagccactaaattttcttttgcttaaattagtcacgagtgattttgtttctttcaccactctccccaatttacacacaagcgtaacagacagagttggaagactgatgggagaggaagcatttgtaatagtgatcatgggataattagagtcaatttgaggtgataaagaatcactagtggcactgagaacccatttaaacttaaatgacacaaacagttttataatggccaagtgtaatgaactacatgatgactattttccacattttacttttttataacaaactatgatactttccaaaagttggacagtcgagatgctggttactggtaaaaccactgagcatctcatccctacaaataccatctcatatgccaactaaacatgcagactaaattttcatgttgcttataacatgacgtttttcccaactcagcaacctataaaatacagaagatcattctaaatccttccttggtcccttaaattcttttaagaacagaagccttggaaacaaaaatattacttttgttattaagtgcaaacggtatggtggatcacctatctttgagagctatgatttccctttggtagactaacccttgatgtaaatcttgtcttggtaattaaaaagcaagcaagaagaaatccagaaactgtaaaaaataaaataaaataagaaaagtaaaagcaagcactggttttatttctaaccacttgcttgactggataagtcagataaccttttttgtcacttactttcttcatccgtaaattgagaacgttagacaaaattttaatgcagctcaaaccttctagaatctgcactgtgattcctctatgtagtttgattcccatatggtactcagatctaaaaatagtattactgtgggtagaaacctaagaggagtgtggtgacaatcccatgagtttcagatgagcagtttcatgaagtagctcatattagatttccagaatactgaccccctaccagactgtgctagaggagtaataatatgactcatgcaatggccaaagtcataattaaaattcattaaatgcattagatttaaagtaataaggaagttttaaaaaccaaaattagactttgcattttactaacatatactgtactttttgtcctcaatttctggagagaaaatatgccactctatctattttcagtttttacttctgtttttggaggagatacatttctttctggaagctgtcttttgagttccatggtaaccgcatccttccagtcaaatctgtcctgtgggatgcgcaatttaagacatttgaaaatgccacctaagaagatcacactaaagagacctgaaagggtatgctttaacatgaaagtgggaaaatttctcagtgttagtccaaatgaaatgccaagaatgaggaggagaaacaggattcaaccaatccagcaatttttgccattgctccgaacaacccgagtcttttttaaatttttttcctggctactttctcaccattaagtcacagtctagtatttgtccctcatctggttctctgtattgaggctagaaaacacaaaggccagaaacaacaagattatagctaagagataagaagggtcaagagactggtgacactgtcgtaacagacaggattctgcataaacagagtgtgcctcaaagtccatgcggtcacttatccctcctctggcagaaaccagctccccagctttggaggctctggaaacataattggaagaaatacacctgatgattccctgccatcagggaaatgaaagtcagaggatgtccagtggtgaggttcaatagggaagtgacatttgtcctgaggtgaatgcagacagcagattcatgtgtgggcacagtgtggcacaatcctctgcacctgattccagggatgaagttttgtccctgcctcagtggtaggcaagaagcaagggacagcaaatctgagtcatttttatatgactatctaaataaaagtaattctagatgtacaaggacagcaagtctgttacagtgttctagactcaaagcaagcaaaggcagttaagcatagtattagtccattctcaccctgctatgaagaaatacccaagactaggtaatttataaatgaaagaggtttaattgactcacagttcttcatggctggcgaggcctcaagaaacttataatcatggtggaaggcacctcttcacagggcagcaggagagagaattagtcttgagtgaaaggggaagacccttatgaaaccatcaaatgttgtgagaactcattcacacatcagaacagcatgggggaaaccatctccatgattcagttatctccacctggtcccacccttgacacatggagattattacaattcaaggtgagatttgggtggggacacagagccaaaccatatcattctgccccggcccctcccaaatcttatgtcctcacatttcaaaacacaaccatgcccttccaataatcccctaaattgttaactcattccagaattaactcaaaagtcaaaatccaaagtctcctctacgacaaggcaagtcccttccacctatgagcctgtaaaatcaaagcaagttagttacttcctagatacaatggggtaaaggcactggtaaaaacactcactcgaaatgggagaaattggccaaaaaagggggctacaggccccagcaagtccaaaatccaacagggcagtcaaatattaaagctctgaaatgatctcctttgactccatgtctcccatccacatcacactggtgcaagaggtgggctcccacaaccttggcagctctgcccctgtagctttgcagggtacagcctccctcctggctgttttcatggcctggtattgaatgtctacagcttttccaggtacatggtacaagccgtcagtggatctaccattctggggtctggaggatagtggccctcttctcacagatccactagtcagtgccccagtggagactccatgtcggggctctgatcccacatttcctttccaagttgccctagcagaggttctctgtgagtgccccacccctgtagcagacatctgcttagatacccagacatttccatacattctctgaaatcgaggtggaggttcccaaacctcaattcttgacttctatgcaaccacaggcccaacaccacatgtaagctgccaaggcttggggctttcaacttctgaagcaatgacctgagtggtatcttggcctcttttagccacagctgggacagggcaccaggtcccaagactgcacaaagcaacaaggtcctgggcctggctcaaaagatcattttttcctcataggcctctgggcctatgatgggatgggctgccttgaaggtttctgacatgccctgggagcattttccccatggtctgggtggttaacatttgtctcctcattacttgtgcaaatttctgcagccaccttgaatttctcctcagaaaatgggtttttctttcctatcacatcaccaggcagcaaattttccaaacttttatgctttgcttcccttttaaatgtaagtttcaattccaaaccatatctttgtgattacaaaaagctgaatgcttttaacagcacccaagtcaccccttgaatgctttgctgcttagaaatttcttctgccagatactctaaatcatctctctgaagttcaaattgccatagatctataggacaggggcaaaatgctgacagtcttttgctaaagcatagcaagagacacctttattccagttcccaacaaatttctcatctccatctgaggccccctcagtctgaatttcattgcccatatcattattagcattttggtcaaagccattcaccaagtctctaggaggtagcaaactttcccatgtcttcctgttttcttctgaccacttcaaactgttccaacctctgcctgttgtccagttccaaagttgcttccacattttcaggtaacttcacagcagcaccccactcctggtgccaatttactgtattagtcccttctcatactgctatgaacaaatgcccaagactgtgtaatttataaataacagacatgtaattgactcacagttcctcatggagggggaggcctcaggaaacttacaatcatggtggtagctaactcttcacagggcggcaggagagagaatgagtgtcaagtgaaaggggaagcacctcataaaagtatcagatctcatgagaactcattcactatcatgagaacagtatggcggaaactgtccccataattcaattatctccacctgttcccacccttgacacatgaggattattacaattcaaggtgagatttaattgaggacacagaaccaaaccatatcaagcacctttatatagcaacatcaaaatagtaggcaaaatggccttcttccctccactaattattatgtagtagacatggatattttttctaaatattttagtatattatttggttagaaaagaatgttatgctattattgaatgtttgagaaaacaataataataaaataatattgaaaaagcccatttaaacacccaccaagttaagcaagaatcaacacataatttgcaatcaaaagcattttaaaaaacaggggacatgaagtccttgcccatgcctatgtcctgagtggtattgcttaggttttcttctagggattttatggttttaggtctaatatttaagtctttaatccatcttgaattaatttttgtataaggtacaaggaagggatccagtttcagctttctgcatatggctagccagttttcccagcaccatttgttaaatagggaatcctttcctcatttcttatttttgtcaggtttgtcaaagatcaggtagttgtagatgtgtggtattatttctgagggctctgttctgttccattggtgtatatctctgttttggtaccagtactatgctgttttggttactgcagccttgtagtatagtttgaagtcaggtagcgtgatgcctccagctttgttcttttggcttaggattgacttggcaatgtgggctattttttggttccatatgaactttaaagtagttttttccaattctgtgaagaaagtcattgttagcttgatggggatggcattgaatctataaattatcttgggcagtatggtcattttcatgatattgattcttcctatccatgagcatagaatgttcttccatttgtttgtgtcctcttttattttgttgagtagtggtttgcagttctcctggaagagggccttcacatcccttgcaaattggattcctaagtattttattgtctttgaagcaattgtgaatgggagttcactcatgatttggctctctgtttgtctgttattggtgtataagactgcttgtgatttttgcacattgattttgtatcctgagactgctgaagttgcttatcagcttaaggagattttgggctgagacgatggggttttctagatatacaatcatgtcttctgcaaacagggacaatttgacttcctcttttcctaattgaataccctttatttctttctcttgtctgattgccctggccagaacgtccaacactatgttgaataggagtggtgacagagggcatccccgtcttgtgccagtggcaacgaaagccaaaactgacaaatgggatctaattaaactaaagagctcctgcacagcaaaagaaactaccatcagagtgaacaggcaacctacagaatgggagaaaagttttgcaatctactcatctgacaaagagctaatatccagaatctacaaagaactcaaacaaatttacaagaaaaaaacaaacaaccccaccaaaaagtggatgaaggatatgaaaagacacttctcaaaagaagacattaatgcagccaacagacacatgaaaaaatgctcatcatcactggccatcagagaaatgcaaatcaaaaccacagtgagatatcatctcacaccagttagaatggcgatcattaaaaagtcaggaaacaacaggtgctagagaggatgtggagaaataggaacacttttaccctgttggtgggactgtaaactagttcaaacattgtggaagacagtgtagcaattcctcagggatctagaactggaaataccatttgacccagccatcccattactgggtatatacccaaaggaatataaatcatgctgctataaagacacatgcacacgtatatttattgcggcactactcacaatagcaaagacttggaaccaacccaaatgtccaacaatgatagacaggattaagaaaatgtggcacatatacaccatggaatactatgcagccataaaaaacgatgagttcatgtcctttttagggacatggatgaagctggaaaccatcattctcagcaagctatcacaaggacaaaaaaccaaacgcatgttctcactcataggtgggaattgaacaatgagaacacttggacacaggaaggggaacatcacacactggggcctgttgcagggtgggaggagggggagggatagcattaagagatatatctaatgtaaatgacaagataatgggtgcagcacatcaacatggcacatgtatacatatgtaataaacttgcaggttgtgcacatgtaccctagaagttaaaatataataaaaaatataataaataaaaataaattttaaaaaaggggagaaattgattagaatgattttcatataattgtttagattaattatttgttatgcatttgtttgtccatagtttattatcattgtaatcaattaatcaattttagctatttccactgtttccatttaatataagtcaagaaagacataattgttttccattgtgcctgaggtagcgtgcctctaaaaatatcaattactatttttagtcacataaattttcttcaatattttctgtaagctctaatatgtacttattaaaatatttaatggtagctgacagagctagtaatttaatgcacaagtgagcaataaaattattttatgctgttggatgattaagaaaactgtcagtaaggaataagtcttcaataataatatattaaattataataccttatttcctactaaataaaaatggaaatcatcttttttgtactatttcagatttttcacaaataatttattcttccattacagctaagaaaatttctatatggacctggactaccatttttaagaaatgtttaaatgtttaactttccctttatttattttatcctatttttcaagtcagatgttttaccttactttagtttttgtctttcatacatttaaaaaatattcatatatatatagtataaaccaggtgctatgccagacatgtaaaaaactgtagggaacaagaccaaaaagaatttacaggtggtaagaaaataaatctttcaaacaaaaatattttgataaaaggtgataaggggtgtgtggaaaacacagtggtaatacagatgaggtaagcagtgattaatcttccagtgagaaaactcaagaaaattattgaacaggaacaaataagaataaggtcttggaaaaactgatagaaattcaccaagcagtcaagatgataaaggcattctaagtagcaggaataattgatgtaaatttttaaaactcatgaaattgaatggcatcatcaaaaatagaaaaaagaattcatttctttagacacactaaagtacaatggagagaagagtagctcacatggctgaaataagagccaaatatttgaccacagagtctgcagtaccctaaggaatttatcttacttcttgatggaagtaagctaatgggaaactactagattgaaacacaggtaattaacccaatttgctttgtaacatactggtttgagattgcttcttctgaaaatatgcacatgtaagctactgctctagactatcactgtacaatagaaatataatgtgagccatatatgtaattttaaattttctagtaaccacattacaaaaacagaagaaatttattttaataatatactttaaccaaatattcaaaaccaaatattatcttgcaatatccaatcaatataaaaaattaagaagatagtagttcacataactttttccctgagtcttcaaaatccagtaagcattttatacttatagcacatctccttttggatgctaaattttcatcagaagtacttgatctgtatttatactacatataatttacagtaagaaaatagatgcatcttcccaagttattacagacttacttgaaagtttcctaataactgaattgaatatcaaaaatcatcttcctttaatatccgcaatattgacaactctgttcatcttttttttagaacaatagatttggtttttaagcaagaacgtgtcagtttcaaaactgtgtctcaaaagtacatctgtctcagataagcaaattcacttttgtgttaactcaatattgacattaaattcactaaggtattacacaaactgaaaacaattctaaatttaccaattcagaaatgttattgaaaattttcttctagtttttacaaccaatttgcataatacagttgattacaattataatgtcctatacattgattcatatttgaaaatgtataaaattgatcttactgatttgtattatgaaaagtttcaatttcaaagccaaatctcataactgcctggctacctcaaaaataagcttttccttttccttggagctttaaattcatgtgtagagcagcgtgactttgctgataaaacatacgtcacagggctatttttgtccctggttattgaatatttgtcaagcattacttttgttttaaaattcttcaatttgggttaatagaactataaatctttgtaaaactcttctatgactcaaccaacaagcattgacaaagaacgcaagatcgttagattcattgtcttctttttctttcaacattttcacatactagtgatgattcacatcatttacacatatattctgaacagttttagcaactatattcatggttctttcatacaatttcctttaggaaactaagtacaaatagtgtcagactgtttcatacaatagaacaaagaaataaggcaaagaccactcttattttaaaattccaataaatccaacatttgaactcatatttgtaaagcatcatttattgtgaccaaaattataattataattattattgatatggagtctcgctctgttgcccaggttggagtgcattggtgcaatctcagctcactgcaagctccacctcctgggttcaagcaattctcgtgcctcagcctctcgagtagctgggactaccagtgcccaccaagagcccggctaattttttttgtatttttagtagagacagggtttcaccatgttggtcaggttggtctcgaactcctgacctcaggtgatctgcctgcctaggcttcccaaagtgctgggattacaggggttagccaccgtgccaggccaattatttttatctctaaatgaaatatttctttgacatattaaaaatgtttttaaaaatctactgttttcaaatttctttgcaaatttggaagttctttgagacaaaatggtaacatggcagagatagccaatactaagtgctggtgagaatatagagcaactggaactctcatgcaaatcttatgattagcaattccgctctataggaagatatctttcagaatgtacatatgtatgtgcatcaaaagtgttcaaagtagcactctttatagtattcaaaacctgaacacaacacagccattaatgagagaatgaaaaataaattgtggtataaccatggagtgaaatactacaaaatgatgatcattactgaaccagaactacctgtaacaaaatggatgagtctcacaaggattatgttaagtgatggaaaccagacacagcgagtacacactttacatttataaaaggttcaaaaacagacaaaagtaattgatgcagataggaatagatagtgtttaaattaaggaggatgggctgggatgtctatgagggacacctcttgctggatgatctcttgagcccaggaattggagaccaacttggataacatagtgagaccccatttctacaaaatattttaaaaattatccaggtgtggtggagcacacctgtagtctcagttacttgggaggctgaggtgggcagatggcttgagcctgagagggcaaggctgcaatgatgcatgattgaaccattgaactccagcctaggtgacagaggaacactctgtctcaaaaaagaaaagaattacttaatctagtaatcccactccttggtatatatccaaaataattgaaagctgaatctctaaaagacatttgcatcaccatgttcattgtagcagttgcttataaaattctagtcttaatcggggtggtggttacatggatgtgttcaaatggtgaaaactaattggtctgtaattattacacttaggatttgcacattttagatatgtatgttttgagttttactgttttttaacagtcttaataaatctatgaaacagcaatttacacagaccacataagaaatttaagggagttgaaagatctgaggaaatcactcagaatacagcatgaaaagataaaacgtaaaataaaaaacagcattaagagacatggaggtcagaataaagagattctatatatagctagcagaagttccaaaatgagaaaatgtagaggctgagtgaaggcaatatcaaaaggaataaaagcttagactttcacctgtctaataaaacacactgtctcagatgcaggaagaacagtctaccagtaacagggtgaataaaagggtttctacaactgtactcgttataggaaattactagatatcaaaacgaccttaaaagcaactaaagaaaaaattcacagtatccataagagcattataattagactgaaagaagacttacaaagcagcaatgtaatccaacagaaagtgacataatgtctgtaaaatgttgggagaaaataactgtcaagctagaaccttaaagcaggctaaattgcctttcaagaaagagtgtgaaacatttatagactaaccaaccctgaaggagttcctaactcacagaaccttactgaaataactacacaagtatgatgaagtcactgaaccaaaaggtccttctacggtccagaatcaaatggagatattgattaaattaagactgcgtcacatcatttgtgcatgttaaaaatgtaaaggtataagaacttcatataataaaaagacaaaaagagagttaaaaacatttgatcaacgaaatacaacagagaaaaaaaaagaggaaaatggtaaaggtaaaactcagtaaacacacacacacacacacacacacacacacacacaaacacacaccaataagacaacagaaataaagccaaattctcagaaatctaaataagtgttataagattaaacttgcttctaattgaattttggaaatctgtctatgtcaacttataagatacaagtgtggaaaccaaaaaaatgaaaaaataaattaaaagaaatgaaactaaataaatggaaaagtatatatgccaggtaaatactaatcaaggaaaagttgatagctaatttaatatcactaatcaaaaattaatatcacaacaaaatatttccacacaaaagtcattgttatagaatacaaaaacaagacaaaaagtttatccaatggacatatatgaaacctggtacccaataattaaagtaaatacatggtttatcaaatacagtatacataaaacttttataaacaccaatcaattatcaagccataaactaagtcacaacagctgccaaaaaatttatataatgttcataatgtcacatgatcaaaatgcaggtaaataaggaaagaatgatgaaaaggtcattaaacacaatttaagttaaaaacttctaaatcacgtgtgggttaaagaaaaattaataataaacttgacaaaatacaactgaacttcagtgaaaaaaattatccatcaaaatgtacaggaatgcagattaaacagtactggaaaatttagagccttatatacatattttagaaagaaaaacattcaaacaaattcacttattctcttaaaagaacaaaatacaaggaaaaacactgatcacaagaagcaataaagatgaaaagagtaattaatagaatttaaaaaatcaagaatacgagaaagaacattttcaaacctagtgttctagatgctaatacgtttgacaaaccactgcaagtgttatcaagaacaaaggaggaaaggtaaagtattagacacaataaaaatataaccatgataaaaattttgaaaaaaaataaaaaacactaaaaataatttcttaagtttgttgaaaatgttgatgaaattcatattttaagtgtttcaaaatgaaatagcaagcctgaactgcataataataatttcaataatcaatagttaaaaatttgcccactgatcaatagccaggcccagatattattaaataagggccccattaaagctttaaggagagataatttctattttgtacaagttgttgcagaatagaaggagcacattttgcaacttaatgctatattactacataaatcttaataccaaagacaggtaaggacatcatcaaaaagaaaaatttgaggttgattttatttacaaactaaaattttaaaatctaatttaaaatggaaaagtaatacataataaccaatcacaattcaaggatggtttaacatctgagtacaaagatagcttaaaattagaaaatcttattttaatacatcatacagatttaagacaaaaatttattgaacaaggtatttgtgcaataaaataaattgataaattcagtacgcttttatgaagaataaaggctttaagcataccagaaatcgattaaaattgtcctaatctcttaatgattatttattttataagaaacagcatactacagagtaaatcataagaagcatttccttttaattcaggaataagctagagtgtttgcttctgtaaatcaaaacagaaattaaatatacaagaactagaaaagaacaaagctgtcatcactcacaaagacagttaatctattatagcaaatccgaaagaacacacattatacattagcaaatgtgagacttctgcaaggttgctgaatataagatcaatatatgaaaataaagataatatgtaacatatttaataactgtgctttgatctaagtctaaaacaatctgtaagactttactgagaaaatttttaaatcattgaagaacagaaatgtcttaaataaaagaagataacagaccatgttcactaataaaaaatttcaatgcttaaaggtagatattttccctataattgtataaactaaatgcaacacttactgaattcccaaaaggattccaaggattccaaggataatatagtcaacataaagtaatacggtaacataaagatctacaaaaagctaagtcagctttgaccaagaaacagaaggaaaaagtacaattgaatattatgatactgccatagtgctaggcaaattgaagaatgtaattaaatatagagcctagaaatagatccctgtagttataagaactacacttaggaattaggtaacattataaatcagatgggaaaaaagtgttggacaactgacaaactatatggttaaaatggaaaaataaattcctattcaaattatgcacacatacacaaacacatacacaaaattagatgaactaaagatctgatgtgaaaaataaaactttataacttttagaacaaaaagagaataattttgtcattagaatagaatagtatttttaagcgacaaataatacaaacaatttttttaagactgataaatttgatcacatgcaagtttaaaaattctgggttagaaaatgccataaaactagactgagcaatatggtgagaccctgccactacaaaaaaattttaaaattagccaggcatgatggtgtgtgccagtagtcccacatactctggaggctacggcaggaggatgacttgagttcagtaggtcacaactgcagtgtttacaccactgcactccagcctgagtgacagagcaaaaccctgtctccaaaaaaaaaaaaagaggccaggcgcagtggctcgcgcctgtaatcccagcactttgggaggccgaggcgggtggatcacaacgtcaggagattgaggccattggctaacccggtgaaaccccgtctctactaaaaatacaaaaacttagctgggcgtggtggcggacgcctgtagtcccagctactcgggaggctgaggcaggagaatggcgtgaacccgggaggcggagcttgcagtgagccgagatcgcgccactgcactccagcctgggtgacagagcgagactccgtctcaaacaaaacaaaacaaaacaaaaaagaaagaaagaaagaaaaacgagcaaagaaaagaaaagaagaggccatgaaaaaaggaaaagataagtcactgactatacaattaataggaacccaaaacatgtgaaaacacactacaaatcaacaagcaaaacacctacattcaatggaaaaataaccaaataatataaacaagccatgcacgaaattggaaataccaaatggccaaaagttatataacaaaataggcaggctcactaataattagataaaagcacatgaaaataacaatgagactctactgcatacccagaagactgagaaaatttgataacaagtactgttgaaagatacaggaaaacaaactctgcaacaatgcaggacaaagtaaaaacttatacaatcaatttttggagaccaacttgacaatatttagtaaagttgaaatgtccatcctatagaatctggtaatttcattttagaataaacaccctaaagaactccatatgtatgtacgaaaaatatattcatagttatagttcttgacagcactacctataatagcaaaacagcataatgaaattgaatgtccacgtatatttaggaggctttttgtataatggaaaaccatacacacagtcaaaaagaagcaaactgaatatgtttagagcaattttattttattttattttattttattttattttattttatgttatgctatgtttttattttattttattttattattttattttattattttattgagacagagtcttgctctgttgcccaggctggagtgcagtggtgcaatcatggcccaccgcagcctctaactgctgggcttaagtgatcctcccaagtagctaggactacaattgcatgcaatcaaacccagctaatctttatttttatattgtagagatggggtcttgctgtgttgcccagactggtctcaaacccctgacctcaagtgatccttccactttggtctcccaaagtgctgggattacaggcatgagccatcacacccctctaagaatgaacattttaagaatcaaattattagagatcacgcatgcagtatgataacatttatatacatttaaacacaaaaaatgatacatagcccaaatgatatagagtatatgcaactagatgtagatatataaatatatgcaaaaagcagcccttgacatgtgtgagcaaagctaacactaacaactagggtctggcctggaactcacctttatgagactgatgacataggcttaatattcttctacttaacataagtaattttacatcaacatcagacaaagccaccttgtgatcattataggccaaaataaaaacaagtctgaattcatattaaacgaaggcaaaccaggaatattatccaaaccacaagtatgaccaaatctcctctatttatgctttcttctctctactgaatgtcatttcctcttcccagctaataggagtgattgttgcttctctaccggttacagctttagttttatcctattcttcccttcttttaggtaagatttgataagacattcaataatagaattacttctgcttcctaacagtaaacattttggagcaaagtcccacttccttgagtcctcccagacttacctaatgcaagtccaaatctgtaataaatcctttctaacaccctcttactgaggtgctccacgctttcttatgatgtgcattctccatcatcgaaatgtaccgaacttattcaaatacagatttcctgatgatctttgttaggaggcattaaccagaataagtaattaaaacagaaacatacagaaaaaagtcattctaatttcaggacagtagttattccttgagaagctgtaagagagaaaagaaggtggtgagaatttgaactgcctcttaaaaactgcattgctcttttaagacatgtaaagtattgaaccaaatttatacttggaatagcagaatcagagactagtctgaagcttcaactcataatttcaaagctcatttagataattatagtactaaataaagaataaaatgaaaaggcaaggctatgattcataatattgcaagctgtgatgctgcaggattgccaggaacagagatcaacaagcagtacagcaaacttcaatgtggcttttgcccgttgttatcttgcatgttgtatgtgtgttgacacagactcaataaaaatcagagggcttgtttgggaagcagtctagtactttaaaactactatcaagcatgtaactttgccaccttttggtaactaaagcgaactacaatttacattctcaagaacaaaattaaccaaatggcatcttgctcatatgaatcctacctaattgagagataatatcacagtcatttattatttacataattaaaatccttaaatagggactcaagataccctcttatttcattcgaacttacttcattaaccttaaaaaatacatctagaaaaacaatctgctacttattgttccctatcccttccctactttttctcacttcttggtcattatttgtgctttcttctctctcaaatgtccaatactgtctatccttcaacttgtaattcatgtgtcaactatttcatgaattcgtaagcagccccaactggagtaatggtcactactgtgaaatcctgttgcactctatttttacttcttatacttattgttcattctttcattcctttattcaataaatattttcatccactttgtaagagagagtgaaggactaaattttccactacggctctttcatttgcttgatccctacagctgtctcttcctcccatcccctctggcacatgaccttcacccaattgccccttctcaccctgttgacataatccaaattcctcaaacaatggcagtgaatatacaagaatcatctttgagcaactattcccaaaactaggtgaacttcaactacttcctcttgctaaactcaataaaagctccgtcttccagatttttacctatattgttctgactgattttcttccagggtttcaatgtcaagactcagatcaggactgtgtttttgggtgcttggcatttcatcatgccagacactctgttgatgtctcctctctttggagtcccagtgactagacagttgggctggtcctgctcctgaccactgttctgctccctttgcttgaaagcactatctaagcttttattcttccatcttaattgtccttggtgtaagctttttcatttgcactgtttcgctacttaatgggtctcccccatggataagacaggcattggagacagtgatggtaaacctacgagcctgatgctcaggttctcttattttgaatcaatgtacttgtgggctgctatccagcttcttaaactgtggcaggcttttattaagaacaactttgaactttattgataatactagaaaaacttggaatatgaagaaaataatcctttgtgatatgccgtaggaaaggagaagtttcaaaatttcaactattcaatgatcagcgttttttattttttgaagtagcctctacaacttaagaaatttctaaaactgattcccttaagaactccttagaaaaggtaataaaagcatggagtacctaaaatcctaagttaaacacttctccctttctcctgaccttactctgatcagcctccctcctggcctcccttaagctgactgcctttttcctcttgttctattcttcctcctgatcctccagcaccttcatggggtcctcctttctttcctcggccagtttttcttaaactaccccctgaatagataatattccttcttaatgtcttataagacaggtggggatgataactaacctcattcgttttatatcttcaaatctttgttcagatcagatttgcataatctagttacgtttcctaaccttcctaagtaaaaacagaagttcactgaagaatataagtttattctaggaatgtgtagtctaagataacctgatatctatcaactcatctctttgtaggacatgaaggtgctaaaactcggtaagaaaaagcgatataaattaattaacaaaatgatataaaatataatgatcaacatttgagagagctgcacacctcacattctatctctgagatcattcctgttgaaatggattggtcaaaaatccaatccttaaaaaagacagagattaaaaataaattaatctcttatttcagagaccccttaactcctacttctgagaatactgttgtctcagtgtggctgataatttcacaagtgctttatccaccttctttgttgatcttaaaactgagatggcagatataattggaaaacagaagataagatagcagaccgtcctcatgttagaattacatttttttttagttctttgaagatacttttgctcagaaaaaaaaggaaaagtgatagaccaaattaagtgttctcagcaactactaagtccaagtgggaaatcatctatatctaatctataggaagatacttctgtatatagcgaaaaagcgaggaaggggtgctaaagaacaattgctctgccttagctcgaaagacagagtcacaaaatataaaagactaactctgtctgatagagtgactcccctctgaggaaatagctgctccattctgcccacaattgcttttcatgaaaagaaagagatttttatgcatgcaaaaagagtgtgttccatggttaataatgtcttccagttaataatgagactacattttctacccttctacctttcatcattcctaatccagagtaacctgcacaaacaacaagaatacaaggattttaatgttagtagtatatatttttaatagtaaaaccacagaaacccctcaaaaatctgtcaaaaggggagtggctaaatcattttggctaattaatttcaaacacactctagtatcatttaggaggaaaactcatacacaaaatattatacaaagaatacatgaccccattttcttatataagggtcttcgaagttcaaaaagagattaagtatcacatcatgcatctactaagtggcaggtccaagttttaaacccattctctgtttctaaaagtcaaaacactattactgtaacacactgcttcccaaatcagtatacagcattgataagacatgttacaactggtgtcttaccatccctttttttactgtgttactttgtgtttcaggggacccagaatgcgatagagtgagaaaccatgaatcagtgaactttaaagcaaactcaaatacttaaaggcaaaacaaaatcttctttgatctttagaatgaaatcatcttgtgattcagtatgccagtgaatgacttgagatgccaccagtgtagccaacttgcttttaaatatgtgatccattttgctctgtttggtaagcttctataagggctggaataaactaaatgactccatttggttgctataaagaatacgtgattcaaaatcctatttatatttttctcagaataaatttaggttaatttcaattaaagtaatactgatataaacaatgcatcctatcttttcaaaaaaaatggtgaataagttaacttttcttattgccaattggaaaaaactaagaacttggaaggtaactaacatttcaaaagtgttacatgttctttgcagaaaattttgaaaacacagatgaggaaaaataatatctacaggtatgtatatcaccaagagatatatagttactaataaatttaaacagatgacatgttatgaacaagttaaaattccaaatcaacctattaatatagtaacagtaggatattggtaaagtctcaactgtagaagatacaattaatcaatgtcacaagtacttaataacatagaaattgttgaaaatggaatatttatttggtttgcaatattttccaaattctgtattaagtatactgtatatgatgtatgggtataatagtgcattttttgtaattacctcaagttaaaatatttcctaacagcttttttagtaactcttcataatcataccttggcataaaccctgaaatatttgatctactttgttttttattttattatgttttctattacattggcttttattaatcctgaatctctccatctgtggccttttcctatgacctttactaagcaaagttgctgttaacatctggttgttaaaatataatttgtagtagctttgtaaataaaaaagcgtgaaccacatattattacttttgcaaaggatttataaatatgagtcagtaaactcactagtttccatcctggaagagtggcaggaaattagacttttatcttttggggaagctttacatttcaggatgatgaagtctcagggggttttgggggactcaaggtagatggtaagatcccacatcgttctgctttggtgaccacagacacttagcccaatccatatagttcctcaggccacaaagttctggggtctctatgacaaactttttagggtcacaggtacctagcatcctgcctccctaaatgcaccagaaaattatcctcagatcattcaacctgctcggggaggtgcctgggattctgatgtgagttcagctattcctgagatccagacatgtctgccccctttgaagccttaagccttgatctgactcttcaaaagccttattacttcaaattctgtcttcactctaccccagttatggacccaacactatttctttaaagagtttaagaaaattcaaaaagcctttaactccaaaaggcttctgtttctgttttctgcttctgtttctgtcttctgcttctgttttctgccttgcaaaaatctccccattagataggcaccacaggccctgtctatcttcttggggtgggggcaggagacagggtagaatctggggagaaatacataaaataatatcttagtaaagcaacttgccatcacatttgttattcaaggccatattctgtgttagtcaatgaaaagacattgatgtttgacaggacttttggttcatttgtttgtttcaaatcacccagaaatcctcttctttgaggtggcatctttcatttgaatagtgtatcagggaaaattattatattcactgaaaatgtttaattcaagatgattaactcaagcacttaaagatctcgtttgcctcatgaatcagtcagggcccaacatagaaaacaaaaagcattctaagcatttaaatcaaaaaagttaatacagggaataagatgaataggggacagaagagccaagaagccacatagaagacagggagacatcctcgggattaggaaatgtaggaagctggtgtccagcctgggctggagggaggaggtgatgcttgtggtgtccagggtcagtgcaagtggctgaaaccaggatgggcttacattggaagctagagcctcagaggagctgcatttgagaggtgccactgaagtcagagaacaaggataataaataccctggcttctccttacttcccactctccaatctcactccagtgcctcccattgatggaataatccagctgaaaggaagccagctgacaggaaagcctgtgaaatgcggtctgcagaggtcaggtctcttgtatattgagaaggggagaggtgaggaatggaccttccttcatgcagtccagagaccagcatatttaagaattctcaatacaacataggacaggattctactcatttattgcacaatgtttctactacccctggattcctttagtgagtttatttcttgcttaaactgtaaaaacgttagagacccattctttggaatataagatatttaagattagggaggcatgcacttgagaacttaagaaagaagagtttagtactagactctacactcctttttattctaaaatctctcccagaaattttaaaatgtgtctagaaatgcattgttaattgggtcaattgagctactttggttaaagaataaaatcagcctagatttcagaactgaagaatcaggtcctctgtacaagctagtgattctaaaaattgactttacttaaattagaatccctcttctcttggcaacattaatgatacctgttatattttactaaagttggcaagtaagacaacactaagcctctcttctcaatttcaaattgtaaataatgagagacaggcaagataacaataccttaaatcagaattataccatggtagtttggtattataagctaattttgataaataaaagctatcactctgagagaaaccttctagctgccttaatcatttaccccttaaaccagtgcaactgatttctccataccaatcctgtcttctttcatctatcacataaattttaaaatgatctatgtaaaatgtaaatttgattatgtcattcctctgcctatatcacttcagtggttcatcactgaatggataaaactcaaacatttccatatataattacaagttccccaagacctgacacccaactacctctgacctacttctgtttttgaccttgaacctctgtgaattccaagctgcttcttacttactatattcactgggtctcagagggtttgtttatggtacatcttttatggaaacatttgtctgatttccctcttctggttgatacccatgtagattcagctccagtaagagattctaatgcccaagaatgaccttgcaaacacaggccctcggggaatacgttctccattgtaatgcttgcactgtgatgtgactgtctgtttccatttctacctctcaaacattctgagaaccccttgggagcaggattcacaccttattcttccttggtaaaactaccaacaatggccctcaaaaaatatgtgctaaatgaaagactaaatactaccaaaatattccaaactgacttctattctctcccttctgacattaattatacaaatagccatcaaagttatgcttcaaaataaataaataagatcatgtcatttctctctagtaacattgctgatgctgtccatgaacctataggtcacaaggattcgattactcattcttcaacaccatttgttcaacacctaagagtttgccaggtaccgttctcagtactagagtctaaataatgaataaacagacaagtttccatgctcatggaactgactttctatgctgtttcacacctttccttccttacatactgtattgcttcttttgttaagcaaaaccttagtcagttttcagtccatgtttagatgccacatattcttccacacccacagacgaattatttgcttcttcctctcccctctattgcacagaattcatgtttctactaaacaacttaaaactgtattatgtaattttgtatttatttgcttttcctgtagtattctcctagtcccattaaggcagagataaagaacttgcataaagacaatataaaatagttctacaattaaatagtacaaaacaattttttaaatgaaaaaagcctttgaagaggcacttcacaaagaaagatatataaatagacaataaatacatgataaatgctaagcatcattagtaagtagggaaatacaaataaaaccatttaaaaataagacagtggaggaataacattagctaacttcaaattatactacagattatgataaccaaaacagcatgatactggcataaaaacaaacacacagaccaatggaacagagtaaagaacacagaaataaatccatacatctatagtgagctcattttaaacaaaggtgccaagaacatacacttggggaagagagtctctttaataaatgaagctggcaaaattggatatgcgtatgcagaagaatgaaactacacccctatctctcgccatatacaaaaatcaaatcaaaatagattaaagacataaatctaaaacctccgacaatgaatctaccacaaaaaaaaatggggaaaatctacaggacattgatctcagcaaaatttcttgagcaatacctcacaagcacaggcaaccaaagcaaaaatggacaaatgagatcacatcaagttaaaaagcttctgcacagcaaaggatctaatcaacaaagtgaagagaaaacccaaagaatgggagaagatatttgcaaactacccatctgacacaggattaataaccagaatatggccaggcacagtgactcacacctgtaatcccagcacgttgggaggccgaggcaggcggatcacctgagatcaggagttcaagatcagcctggtgaaaccctgtctctactaaaaatacaaaaaagttagtcaggcgtggtggtgggcacctgtaatcccagctacttgggaagctgaggcagaagaatctcttgaacccaagaggcggaggttgcagtgagccaagatcgcaccactgcactccagtctgggtgacaagagcaagactctgtcttaaaaaaaaaaaaagagagaagaaaagaaaagaaggaaaggaaaggaaaggaaaggaaaggaaaggaaaggaaaggaaaagaaaggaaaggaaaagaaaggaaaggaaaggaaaggaaaaagccagaatatataagaagctctataggagaaaatctaataatccggtcaaaaaatgggcaaaaaatatgaacaaacccatctcaaaagaagacatacaaatggcaaaaaaaaaagcatatgaaaaagtgctcaacatcattgatcatcagagaaatgcaaatcaaaactgcaatgagatatcatctcaccccagttaaaatggcttttatccaaaagataggcaataacaaatgctggcaaggatgtggagaaaagggagcccttgtacactgttggtgggaatatacactagtacaaccactatagaaaaccattaagagcttcctcagaaacctaaaaatagagctgccatatgatccaacaatcccactgcttggtagataccccaaataaaggaaatcagtatatcaaagagatagctgcactcctatgtttgttgaagcactgtttacaatagctaagatttggaagcaacctacatgtccatcaacagatgaatggataaagaaaatgtggtacagatacacaatggagtactattcagccataaaaaagaatgagatccagtcatttgcaacagcatggatagagctggagattactatgttaagtgaaataagccaggcacagaaatacaaatatcatatgtccttacctatctgtgggatctaaaaatcaaaacaattgaactcatggacatagagagtggagaatggttaccagaggctgggaaggatagtggggggctgagggcgaagttgggggcagcagaggtgggggtggttaacaggtacaaaaaaaattagaaagaatgaaaaagacatagtatttgatagaaccacagagtaactatagtcaatagtaatttaattgcatattttaaaataacttaagaatgtaattgagttgtttgtaactcaaaggataaatgctcgagaggatgaatacctcattctccatgatgtgcttattttatattgcatgcctgtatcaaaatatttcatgtaccccataaatacatacacctactatgtactcacaaatattaaaaatagaaaaattaaaaataaaatgagataggattataacattagagtagctaccattaaaaagaattaaacaccaaaggttagctaggatacagaattatcagaactctcatatattttttggtgggagtgtaaatttataactattttagaaaaagctttataattttctttttttctttttcttttttttttttccttttttttttttttggacaaagtctcactctgtctcccaggctggagtgcagtggtgtaatgcaacctccgcctcctcagttcaagcaattctcctatctcagcctcccaagtagctgggattacaggcaccagccaccacgcccagctaatttttgtattttttagtagagatgagctttcaccatgttggccaggctagtcttgaacccctgacctaaagtgatccacccacctcagcctctgaaagtgctgagattacaggtgtgagccaccatgcccagcctataattttcttaaaaagttaaattaaagggtaaaatattcctcaacccaataactccacttttagatttttatccaatagaaatgaaaataaatggcaacaaaaagatgtggacaagaatgtgtgtagcacctttttttgtagtagtctaaaactagaaacaatccaaaagtccatcagcaaaaggatggataaaaatttgaagtattctcatacaagatgctactctggaataaaaaagaacaaattactgatatggggaacaacctggatgcctttcataaccattatgctgaatgaaaaaagctgaacaaaaagaatacatggttatgatatgggagctaaaaagaaattatttaggtagttagtgatggtaagagattcattggtaaggtttcccttttaataaaaagcagcctccaaatcatttatttcctaaaaaagagcagcctgaaaaattaagctgcagacataaataagcaagttagaagcttgcatggatgaatgtcagcagctgtgccaataggaaaaggctacctgggggccagacatgttcaacatgcaggctccatctttcctttctttgtcaccatatgtacagtaaggaataggcaacatggcatcggacaggtagagaaccatctgcaaaataaaagatttgggtggggtggccagattcttcctcgctatacaaatggcgcacctggtccgaccaatcttgtttgccctatgtaaatcagacaccgcctcctcaagctcatctataaaaccccgtgcatttcgagaaggaaccagcaacccatttttctccgggacccctctctctgcagcagagagagctcttctctttctttcacctattaaacttctgctcttaacgtcacgctggtgtgtctgcgccctagttttccgtggcaatgggaaaacgaaactcagctattaccccagatgaacgacacagcttccgttatgattccatttttataaagctctagaataacagctaatctatgataaataaatatagaaataaagatatctaaatatgtacatatgttttctagagagagctgagaagcaacaacacgctaataacagtaagtacatctataacccagatcttggtttctgaatattaatcttcactaaaagaaaccacggctccttagagaaatgactgattctggggttgatgaagggaaataatgataagctggaatctcttgttgcaacagagagtgacaaaagttttcgaataatgatggaatcctatccaaaagacacaggaggctctcattggccaaactcatgtcatttgactatcaaaataaataactctaatagattgtaattcattgaaaaaaaaagaatcaatgagtaaattaatagataaataaatagaaaaagtctcccttaaaggggaatgtatactagtaaatatagagggaatgatgaagtaagaaaatatcattgaattacttgaagctaaagctaattaggtgaatatttgatgagaaaaaaatttatatatcatctcaaagtatctccccacaaactacttactaattacaaaggggaaaaggaataacttcacactggagaagctttaatcaaccaatcaacattaacacctgcaattttaggacaaacaacaacgtgcctcctgatgtgatgcactgggaatagcaccatgtgttcctgtggtattcctgcagaaaaagcaaaactggaatttaatcttgaggaatcagcaaacaaacccacactgagggacattccataaaataagtgtcctataatttttttaaatctcaagattaaaaacaatggttgagaaactctttcagattgaagtaatctagagaaccatgataacaagtccagtggagggtcctggagtgagtgaggaaccaaggaaaaaattgggacagccagccaaagcgaatatggaccatggataacgtgatatatagtatcaatatcacacgccaaaatgggatcattgtactatagttatgtcagagaatgtccttctggggaaatacatgtgaagagaatatttttctcaaaataatagaaaacaaaacttgaaagagatttctactatattctatgtggatggagtaaaagaagtaaagttagggagtagcacactatttttttcaatgtttccaatgacattcaaaaatataagtaatgggaagatagccacatttacagtaaactctattatcattcttaataaaaaaagtttaattatccatgaaagacactatttacaacccatatttattattctgcctaagatagcaaatgtgtttttcagtttatgacaggcaaccgatattattagaaattataaagaagacaaaagtcaaatttcatttaaaatatctgctttcagtaaagtgtcaagcattcttagacttgagctaacataaaagatatttgactttgagtgatattttacagatacatgtacacatgtgtctacatacatatgtatacatatacacacacatatatatacacacacatacatgttcataaacacatataaaatgcacacatttaaagtaaacattctattttttgagatttttctaaaaaaataagacctccagaacagtcaaaagtagactaccaccacttggcactcaacactggtaaccctgaaaggatgaacgtttggagattttttggtttattatatctgaacgtgaaggtatagtatcttgaaaaagataatggcctctcctgaccacaaagctcctacaatttatggaaaaaataaataactaattgcataattcctgagtgcttttgtctaatcttgggcttagtgctggttgttattaaatatttcctgaattactcatgtaagatacatcaaaagtaaccaaagaagttattttcagcatcttcagaaggtacatcaattttaaaatttgccatttcttagttcaccttaaaccagacggatattgtaagaaagggaaattttttcctctaccctcgtaagttcagtggctggtgccctgcaagttaaacctacaaaagggagattaacaggaaaaatcatttatcacatatgcatatgaagtccttcatagaaaaaaagcaaagacccaaaaaagcagttaaacccagggatacacagcattttaacatagagcaacaaactgtggaagtgacaagatgaaggaaaacaggattaggcttttaagggtggttaattgtgggaaggtaaatctgtaggagaaactaatgaaagataagggttgtttagtaaggtctgttattcagattcctctcagttgctgtctctgggctgagcctaggtcaagcttgtccaatccactgcctgtgggctacatgtggcccagaatggctttgaatgcagcccaacacaaattcataaactttcttaaaaggttctaagtttttttgtgattttttttttctcatcagctattgttagtgttaatgttagtgtattttatgtgtggcccaagacaattcttcttcttccactgtggcccagggaagccaaaagattggacacccctggagatcatctctggtgattacaaaccattctccctttcctggcacaagagaagggagaaggtggggcaccttcacgaagggaaatttatgacctgattttagccaaatacaggagggtagaagtcttttcaatgtttactgtttctcagttgccttcggctcaaaataatccttatgccaaagtgctatattttggggtggcatactctgatccctttcagtatatattttctaatattaaggaatcatctaaaaatacgggtcttcatattgtctaagaatgctaattttggaaaaccgccgatgttcatgctttcctttaattgtgaagatgcaatgccttttgtcctttcgtcattaagaaaaaaagagcatttttgtagacttttactaaatatcagcacttagtttctttctcaattagattgaaacagctggtgtggaccgcatttccctgtatctttgcttaccagaagcatttgggaagtcaacagaataacattgcagcagggacttctcttggtaatgaaaattgcagaatggtttcaataagagtgaacatttaaggcccattaagtcatctttcttattgtgcttaacaccatcaaattcaatgagtgaatcaatggccacagctggatgcaagaagcattgaaattcaagaacgatgtcactgcatcagtgacaacaagcctaagaagtagtgggtgaaagatagaaagtcatcactgaattttgattgtagctcagcatcagattagaggatgacttgatatctcacaatgattcattaaacctaagattcatgatgtcaaggggagggaaagacagcacaaacattcttgaatgtttagcagtgagcacttaaggataaatttataatttggttttggcttttgatttagtcaagataatgcaaaccacaggatcttttcatttttatcagacaaatagataaaaaccaattttagaaaacaagccttcaaactccagtgctcttatttttctctcctcattattttttatagaccgtaaccatggtgatattcagacacacagctctgtttcttgcatagcttccaagcttgcatgtctgcatgtcaccacctccgcacgacagcagccacacttagactctttgaaatccagttttacctttctttatttcatttccttgtaattctaatgagtccaatccgatactgcaaacttggggccaccaccaagcacatctttcccttctcagagctgtgggtgcagatgctgcgattgacttggatggaattctaccctgatgagaacccaaattaagttgggaaatctcagctacagaagtaaggaacattatcagccactgaaatagatgaaagtgaagagcatttatgacatcactgaaagcaagttttgtctttcagattctgttaataggtaaaattaccttcagagtcacagcagaccagccatctgccacaagaacaaatgacctgtggccattccagttaaaagagctagcatttctccttaaaactcataagtacaacttacctcttagccattgcagctgacaagctcagtgggtacctcaagaataatttggcttctctggtgtaccatggtagctttctggctgccttactacctcttcctggtctgtcttacagaacacctgctgcctcagaacactggtttttctctcctacatgccattcttccacctccaatcagattcacgtacacatgcatacacccaagaggactacttgttcccatgagagtcctctagttttaattgtgctcttttccaatctcaatcccaactaaatccactttattcctagactctccttgtctctcattaaattgctggtctcaaaaccgcatctgtttgaagtagcagaccttctagacatagttcaaatgagcttgcatctacatctgtgtcctctgatgttccacgaatcctaagtctattcaatattcatgcacagtcagtcccagcctctgcatcaaaaatcaaaactgtggataggagttgaggacatgctacccccaaatatgacaccttggcatttgcgaaaacagcagaagcaggaaagtcactctcaccttctcttgcccttctgtcctgaaacaggtcataaaaccctccggtgagaaaggaatatcctcttatctgaaggcacaggggcaaagaaagaaaactgaaccaacaggcttgctatgtttcttctggtttattactattagatcacactttatatccaatctttatgactatttacttcttcatcaaacctagcataaaagataaacatgtttatctatttctttgggtcttcatttacttatgaaggctcccatgtcacataaaaggtgtattaaataagttcgtatgctttttcctccttattctgtcttttgttataggggcctcagccataaacctacgatgggtaagggaaatatattcttcgtctcctacactgttgaatagtaaaggatttttagggttaacaggaagcagggaataagtgaatgtaaagactgaatgtgagcagagaaaaacagtaaatgtagaaaaaagaatatattaacgaataactatttggccatagttatcatgttatatataatatcacttattactatgtaatttatgaaaacctgtcaagtctccatttgtctagtgataattttttaaaatgcaatctattttaaacaatctagagattctaaataatttgtccacagcagatgccctattaccactcatacacaaatcccaacatactaatgatgtcatgcctatgaatggggcagtctatttctaacttatctgaccttgaacatgcctagattcttcagatccctgtgtcttctatatcctcatctgcaaagtgaaattgattagaagactgccaatatcctaccagtctctacaggctagtgttactcattcccctggctttaatttgaacacataaacaaaaattatcaaacatagactgaaaatcctcaagttttccaaagttaaaaaaaaagacagtttaaaagaaaagatacctgatctagggataaactttgaggaagaagaagtttgtatcatcaaaggggcctttataggaaagttgccttagctggttccagcaaatagaatctttatattcctacaaggataaagaagaagatctcaacaaaggaaggatatttcaacaaaaatttaaaagctatttttatgtagaactatcactgaggctttatttcacatcaactaaaaatagactgtgtgaaaacaattcaaataaatttgttatgaaccatataagaaaagattgtttttctcatattgtattgggctttgtctttgcaagaataattactagaaaatgagagtgagctagctttactgatttgttctcttatataccctatccgtaaaagcacacaatgattttctgttttcccatcgctcttgaacgaggatgctccctgtgttatcctgatcactgcattttgccactagaggcagacaaaaaaaaaagggcggggggggggcaactagctcataaccaacttaatcaggtcttactataactcagaaatagtaactgaaagaaaaaaaatgctgttaatacaagttcttttattatcgggaaagataggtcagaaaatatcaccaattagctagtagtcatcaatgattatgtgataacagagaaaagaggcgccttgactgaaaaaggcaaatttagctttagtcaaacacatatcagcggttgctaagacagtccaaatgttttcagatcctttctccaactggcgcatttggataagtagtcatacttttcaaaatttcacatgtatgatcagatttaatcatcccgataatctaggaaggtagagaaatgccagtgtaaatatagagtaagtttaccatacttattcatgagtaaactgttattaatatatttgtttataaataaattccttaatggtaactatgaacatggaactgacatgatagaagaatgaaagaagccgtgattcctaccttccatcagcatacaatataggtgaagggtgaaaacacagaggacaaaaacattttaacaccatgtggcatattacttatggttttacacaatgaaacacaagtactaaaggaagagcaataacgagaattcaatttaagctacagtaatctggaaaagattcaagaaaaaggtacagtccattgtgaatcacaaaagttggtaggatttgcatagggcaaacagagagagataaacatttctttgaacaaaacaggttaaacaacatatttaatgagaaataatcataagtgtatttacagtacagtgagaatgacatcaaaatataaattaaaaaaagagaaaccaagtactacccttgtattaaacatgaagagctcatggagtataataaaaagcccacctattttccactgtcactacagtttcagagtagtccctggggcatgttatggtccagtggtgtgctagtaagctgaccctgactttctggggggaaacagttctgattggcagcatttatcagtttctgtggcataaatatgtccatggtggccaatttcaagctacagatgtgctaatcacaggatcgcagtgttcctgaatatttaacaaccatctctctcaagccagtggaattctgctacagcacaccactggtttccctgacccttgaaaaaatgtgtttctaccatatgtcttctctggctattcttaggctacataaatttcaaagtctccaagttgcaaaacactatctccttttaataataaaaatgatgaaactcatgtaataataaaagctttgaacctgctttgaagctgggcaggggtgcaggtgctcccagcttatcttcttcgtcccctcctgctgttactcctcttcttagtcgggtacataattcactctctcagccttactgggctggtgaatggaaaggaagaagaaaggggcccaacaagcactgtttgactgagactatgatgagctggtgttataaccacaggacatggaatatatataaagcaggtgtgctcttttcatattaactaggcttctgaaatttctgtctttagcacccttctacatgacctcccataatcaggatgattgcttctctattctagatattttgctttctcctttctctgtcctaagaaatcaaacaataattccacactttttctgctgaaatctgcctacctctctaaaccggagttcaacaactttttctgtacaaggccagataataaatattttaggctttattggccagatggtctctgtagcaactactctactcctatagcccgaagcagccatatgcaatccataaatgaatgagcatggctgtgctccaaaatttacaaagaggcaatggggtttggcccgaggtcttggcatgccaacctctccctcagacagccttaaataacatgtattatgacccttgctggctcactcttatacacagtccattgcaaatgcttacacatcctatgccccgataaaccagggtggtgaaataacctcccaaatcttgggctgcctaggccagaaatcacttagatttctcaggtgtcttagacaccagtctatccagccctccaaatgatagggacatatattaagcttttcagctgacgttaggatccttctcttttgacttggacaaaaggtttattaccagttttgggggcagatgaaggggtgacgagaatgagactcataatacaaaatatacacttaaaaaaatcctcaaaactcctctctccatctcaaaaatataatacgtttcatgtcctaaacattggcaagaggtttttcatcccctagtttgaaaatactacttaaggcccagtaacaccttggaatatgttagctattatcccctgcttttcagctcaaacttccattttagcactctgtgtaaaaggtttaataggagtattggcatagatcattgacataataagccatgtatcccaaataaagtgatttttaactctattgacggaggaacaataaagtagttagggtgaaaagtgatgagtgacacaagaaaactactctttaagaaaacataagttcagttaagaactggttgtattgaaaatcaggagatattctgacagcagggaaattaattagaaggttcttacagataatgtaataacccaaactaggattatatgtacgaagatggtgacaaaagtgggaatatgtaagagagaccaaacatctgaaggtgagtgattgcaggaaatgaaagaagagtgagtaaacttttctcccctttcaagtttagatgtcaaaaaaatgacaaaaataagcaaatcaagaagggcaggaaacggagtgacaaagatgatgaattctattcaggacaggcataatttgaggtcattttaacacaacaaactgatgttttatgctaagctgtggctatatctatacagattttgaaagctaaacaagtagatgataccatgcagaaacagggaagttcacacagcaaaggaatacagaaaagagagagaagtttggaaatgctcccagccaggagtaggaaaaagaaataaaaataaacaagtaaacaaattgagtttattttttattaactttatatgaaattttggggaataagtaaagtttttaatttgataaggacaaaaaagttcctcaaagccaatttttaaacatgtttaaatatttgtattcaatatacaaggaagatgagaaatactcttttatgtaaagtagtaagatttgatttatataccacttctgagtatcaactcatggttcaagcataaaggtcttgctgggcatggtggctcatacctgtaatcccagcactttgggaggttgaggcaggtggatcacctgaggtcaggagttcgagaccagccaggccaacgtggtgaaacactgtctctactaaaaatacaaaaattagctggatgtggtggtgcatgcctgtagtcccagctacttgggagtctgaggcaggagaatggcttgaacttgggaggcagaggttgcagtaagccaagatcacaccattgcactctagcctgggagacagagtgagactccatctcaaatacaacaacaacaaaaaagaataaaggtgtcagtaccagtttgatttcaaaagaccatattgtctacctggaaattcacatcaactgtctcagccttatctcctcatattcacaatgatagtggatactgcacctacaccctagaatgatggtgagagttaaatgaggtaatgcaaataaggcaagagcataatacctgtcaccttgtaggtgataaataaatgttaggtatcattatcatgttcattatcaataaaatgagagcaaacacacttttctctccttactaaagtaccatataattttttaattgcatttttccctaaaatttactttatatatacatacgtatatggcaaactggttctaatggaaacaaactcctagcattttctgtagaaaatttactaactcttctgcatgagtaagattatagacatatgtcattgcaaataagtgcaaaatatattgctgaatttctttttatgcattgttctggtgtcatttcaagttgaccatatgctttataataacaatctgaaccttcaagacaagtgtttactacaggaaaattcacatctataaaaagatgatttgtaaacaaacagaatcacccactatgtcttccaagaattgtgtctatgcgtatatattcatgtgttttaatacttatatatggaacaagaatgcatctatgtaaagacactgtgttatacacataaggtcatgtacttctgttcagtaacttgctccctttcccaaagtagtagctggtaatcctttaagatgtaaacagattgatcatgcctttgctcacaaccctgcaaaggttcccatttcattcagaatgaaagtccaatccttgcactagcccaaagtgctgagtgatttgatacccttacatcatcagccccatctcccactactcatccacctattcaatccggccacatcagcgaatttgcttctcctagaacagaccaggcctgttcctgcctcaagattcttgcacgagctgttgtatttgcttggtgctcttgccctgccccatcccttcatctccttcaagcctttgccaaaacgtcactttctcaatgaggcctactctgaccactatatttaggattgtaaacccacccggatagcatggaattctccaaccaacttccttcacctgctcttcttcctttctccatcatacctaccacctggtaacagaatataaaaaacccttgtttatgaagcatattttactcttccctctcaccattgacatcatcaattccacgtgactgtaaaccaaagaagtgtctgagacaggtctcaatcaatttagaggattattttgccaaggttgaaggcctgcctaggaaaaagccacagagacacaagtcaccataggatttgtgccccacattttccctaagagggtttttagggcttccacatttaagggaggaaaaagtgggcaggaggggaaagagaaaaggaaaaaaaaatgtgtggggggggtagggatatgtagtgaggtgagttgtcacatttttgtgaggctttgattagtgttcacttaatcctgaatccacatgctgcatgtggaaagacggggtaaaggaacagtcaatcatgcatttgtttcatgctcagcaaatcagcattttgttttgttttgttttgtttttgagacagagtctcactctatagcccaggctggagtgcagtggtgtgatctcggctcactgcaacctctgcctcccgggttcaagtgatttctcctgcttctgcctcctgagtagctgggactaccggcacatgccaccacgaccagttaatttttgtattttgagtagagacagggtttcatcatgttggcctggctgctctggaactcctgatctcaagtgatctgcccgccttggcctcccaaagtgctggaattacaggcgtgagccaccgcgtccgcctgcaaatctgcattttacataagataaagtaaacataaggtaaagaaagaagtcaaatatgcatttgtcttgtctagtgccagtgaagataagcagttagtttacattgtcagagcgagggggggccacttggggagatccgtagccttctatcttgcagctatctgtttaagaacaaaaggaaaggtagttttttgtatggctcagttttcaagcttaacgtttccctttgccatagtgtttgcggccccaacattttattttcctttcacaagacacaccccaagcaataacaatcaagaacctagaaaagtgactggcacagcgcacatgctcaataaatatttttacacaaattttaattaatattgattttaaatgttgaaagatattgccaaattggccttctaaagcttttttgactgttatttctttcccaaagacagagaaaaatacacaaaataaaaccacaatagtattgagtaaagaaagcttataatgcaagttatgaaaatcaaatgttatttaaaaaagaaaatactgacaaatttaatcatattacaatttaaaatatttgtctgaaaccaaaaggcaaataatcaactatggagaaatatttgtaacatctataccagacaggaggctatccttccttaattaaaaaggattttttttttttttttgacatggagtctcgctctgtcacccaggctggagtgcagtggtgtgatctcagctcactgcaacctctgcctcccgtgttcaagcaattctcctgcctcagcctcctgagtatctgggattacaggcacccaccagcacatgcggctaatttttgtatttttacatagagatagggtttttaatggagatagggtttcatcatcttggccaagctggtctcgaactcctgacctcaaggtgatctgctccttggcctcccaaagtgctataagtcaataagaaaaagaccaatcaccctgtagaaaaactgacaaacaggcaatttcacagatgaagtaataaaaatgatcaacaaaaatataaggagctaggcacaatttgataaatgcaaatcagtacaacaatattatttttcatccacctcactggcaatactcagggtatggggaaaaaaagggtatgagaaaccagacaacgctgtctggtgatatgttagtctttttgtgttgtccttggtagttgctttggttatttggtggtttgttgttttgctttgttgtttgtgcatctccaaatgtgaatgtagccatgtggaccttacatttgtcatcctctgctacttgcgtgcacacggggactgggtcatccatccatctcccttctcagattgaatgctgaagggaaggctgatgtgtcatgctcaccattctctctcactcagcctgtttttattggatcaaagtgtgttattctcctatctccacagccaagttctctgatagtctcaccatataaagtagacacatgcaaaacaacagtcttcacaggtccccgctatgcaggcccccagggttcccgatagaaaccacatctgtccctccctttcccgcatgccacttcttccctatttgttttctgtgagttgcaatatacagcggagagcttgggtttaagaataccatccatgctatacaaatacaaaagtctacctttctgtttagtgcatcccctgactctcttagccaagggcaaatgtggattaaaggatctaacgtatacaagctacttaattccatcagctttggagctaaatcaaaattatcccatattttagcaaaatgtgaagttttgcttttcagtagtttagaattttggtttttcttttttttctgtacctactgtttcagagggaagttatgagaacttgttaaaaaatgctaactgtagatcatatgaatcagagttcttgagactagtgctaaatttatattttatttccttcattctgtatcacaccatgggcatccctgtgagagaaaataacccaggaggctggcctgaagagtgtatacattatggggggaaatataataatctgagctaacacacactttctaattatagaatcagatgcaatcaatcagaggtctcacatagtttcaagctttactaacattttcaaggataggagcagtcaagcgtttcaggtaaccaagtctagatcccatgacactccccaagcccctccttccacattaaaaacacagttttcctggccaagaataacaggtgaggtgcgggagaggttctgcagattattattcacataaaagagaatttttaagttatgaaacatctttttatacccccaaagtgttttgctgtttatgggcattctcctacctcttaaatccatagacccagggttgatttactataagcattcttttagctaaggatatcctgttaaaaggatcctgctgatgcgattaagtcctggcaaatatcatccgtctatagaagtccattgaacagggaggctggagcaggtcactggccttgctacctttcctccagcgggtgggggtagcaagaaggcatcaccttggtaaagcaagcgaatgggtcccaaggcagcttcttaccctcctccctccacacaatcacagttttgttttgtttttttttaatctttaagcatcctgaaatttcagatgctctccccattttaacattccttataagagccatcttcttccccaagcactgccccttgcctgcattgaaggaccctgctacagatgctgctgctgatttaatgttgcaagaaaaggaatattagcaacaaataagcaaaacaatgaaacgaagggcttgagatagcaaaagaattcctatcaaaaaaaggtaacatatgacctaacaagaacaaagaaggcagaaacaggctgactggattatacatctgtccatgtacgttaccatagtagtgtgggcggctattaaaaatccacctaacagatgattactcttcattcatcctccttgatacaacattcaccaaatggggagggggttgtcaaaataatccaggatggacatgttaaaatgcgtgagatctggtatgtgggaggaatgagtcggtgcaaaaaacacataaaaagacaatggaaaaataataccaaatggcttaagaaatctcaacttaaggagaaaaaaagctttctaaagaaaacactagagagacaacaatgttaagtagccttataagtcaatgtgtaatttgtaagagattatatactattataataatttttaaataactgaatccttctttcccggttccctatttagtaaaatttaaaacagtttttaaaaagtctatctcattttaaatagtaactgaaatagctgctttagtgataaatcccatcaagataaaagagtaaattaccataattcttttcctaacatattatataaatcttgattcccacaatgaaaatttctatagagagcatattttacacgcataacttaaaaacctgagattgaacatggacagaaaaatgaaaaaaaaagaaactttataatgaagacatatttcagacactcttgatgataaccatatgtgcaagctatgaatgtttttaaaaaacattggagaaactacaaaaatatatgctaggaatttgtcagattttaaggatatgtaaagttttgcttaggtaatggagctgataaagcgggcagcagctgttgagttacatgtggaagaggctttaggagaaaaaatagaattggaaaagaaaaatctttaagtagggaaaagaaatgaggcacacaaaataacatcgcaataggttttaagaaaaattagtattcatcaagaaggtgcagatacagttcctgtccttaacaacaaaaaaaaaaagctacaaatgaattctggaaaatatcttaaattattgtttcccattttcctgtggaagacagtttagcaagaccatagaatgcttggaactaaagatagcatttccttagtctaagatctttggctgaaaagctgttaatttagtttgctggagtttcctaagaaaactgcatatcatgtttcttaattctttttgtcaaaaacatgtgtttccagtagggtgtctgaaatgcagaaatgtatatttaaatttcttttaacaatttgtgaaacaacagcatatcacatgttttatcttatgtctctagttattaataagaaggaattatcatcacatctatacagcattcttttatgatttgtctgcttatatcctttactttttatgagctactggtttttgtcttattatcttataaaatatatttaaataatatggagaaagatttttatatacttgttttatagtcttatattttgaaacaaaactgaactcactaataaattgatataaaactagggaatgtgggaaaattgccttttatcattacgataagatagggtatcctttcagcacacttaatttaactgtatagctaattaaaatatcttctcattaaggactgctgcccatcacttataaaaagaactcaacccttctcatgatttttcttttttttccccttctcatgacttttctggcacaaatgaggtccctggcagtctagtaaaatataatgagtttttttgaggtacttctaaaaattctgtgtatcataaaaggtgacttgtgggtctcactccaccataacctgcttaaatccaggatctcacctttttaatccagcaagatccccggccaaaaaagattaatgggccagaagaagcttaaagagcttttgacacttttacataaacatttctaacttaaaaatagagggtctttttatttttggaccaacaaaacttacccttacttaattaaaaccatcagtgaagtttgccaatgactttccagcaggcttgtaactaccagtatgcaagggtgaataaagaaaaattaggccaaagctttcatctttaataaacagaagtagtcaataggtgagcccatgactgctaatttcctttcaaacatccattctctccttctctctcacattaacagaattcccatttacaactggacacactcctaaatggtcacatttcccaagctgtgatgaagctgggtacagttattgaccaagttatggacaaggagctctaactataaccaagtagggatccaattcagtctgaaatcttactgctgcctcaggactcccctgtaatggatagctatgtagccccccaaatttcctcatgtgtttcagattaaaaagcaccatctatgtgaaagatggttcaaatcattatctcctgtctagacttccatcaaggacgttgtgaagcaaagagaatcttactctagtggactcttccttctatcttctcatgtctggccatctttggtcataaaaggaaagtaacctctaaaggtgatggagcttggcttacgccatcaattgtgcatgtgagtatgtttatgtctgtatgtgtgtttctatgcttgtgaacagaaggggaaattgtcctttccaggaaggcaacatacaatagaatcagtattaattactactgatattattattgccactgggatcctacatgtctggcaggaatttaggacataatgtttaattgatcccacctctgctaccagttgtgttagcccaaacaagtcacttatcctctcttgtgcttaattctcttaccagtataaaagggttaattactttttaaaatggtcttataaaatgacacaaaaaaataaagaactgagaactgttccatgcatacagcaagcactcaaagaatgttagtaactaatatcactggtagtgttaatctagatgatgatataatttggttatttagtcacttactgagttcaaactatgttcacagaaacaatacttaaactactgttcataagaattatacggctgggcgtggtggcttatgcctgtaatactagcactttgggaggccgaggcaggtggattgcctgagctcaggagttcgagactagcctgggcaacatgatgaaaccccgtctttactaaaaatgcaaaaaactagccaggtgcggtggtgcgtgcctgtaatcctagctactcaggcggctgaggcaggagaatcacttgaacccgggaggcggtggtggctcacttgtgccactgcactccagcctgggcaacagagcgagaatctgtctcaaaaaaaaaaaaaatgctttgaatatactctaaaagtctctgaaatattattgctctttattgaattatattgacatgtgtgatcaattataaatatgttcttgcatcagaacattgtcaaagcatatgcttctacaatagatgaggaaacataactccaatagtagtagtatatttataaataagaaaataatttccatcatgaagaaaattaggattatctttaaccaatctgtttatatgtttaatgtgatatttcacattacttggaatttcacactgaaatctttataatgtcaacttaattttaacactgaaatctttatagtgtcaacttaattattaataactttcaataacaaaagattcagaatcttcctttttaatattcagtgtgatctatttaaaaaaaatcatctccaatcttcaattatctaatctcaaaaaataatattccatctcaatcacttaatctcaaattcacttaaatgtcaaatttggctttgcttcttatacactctgtatgcactttttccaattcattagagcactgaaaaagacagtggaaacataattttgttcatatatggatagagaatttcagtattttaatcagagtctttaagtaaatccacgcatgatcctgccaaaaaaaaatcatggaccatcattcccaaagaaaaaaaatgaaatataaataagattacataatcataacctgctaaataagatgaaatagcaaaggcatcaaataattcctaggaaaaaatagaattatgccttcattttgtttattcagtaaatttaatgcattttgaaaatccagttttgtatgcaagaatagagtgagatgtattttacaccacagaaagtattcaaatcctgaccatgagccatcaccttgtttgctgcactagctttcttgcctttgtttttggagtggaattttacatttacttattggagtgtaccatatttccaaaaacagctaacaaaaatggcaacacaaattatattagccttatacagctggtacaggaagtctatataggatggctgtccttcttcagtacttcatttctcttgggcaataatccaggtcactagaactagaatgggagggtaatctgcttctcagggagtaatagaagacccagtttgtgtggtaactgaacacaagccttgaagaccaagagagatgagcttaaatcctgcttgcctacctaatacttacatgattcataatgtggggtaaaatatgcttatgtaaaatggagcttctaatacatcaggattaatgtgaagggttaatgtgaagattgtaagagaaaaggtaatgtgaaatacctgacacatgttagaccctcaattcatgttagcttcctctccaagctaaagcagtgtttagggaatttctgttaacacataatgatacccaaatgtcctataagtcccacaatggtcttcttgagtatcctgatgtcagcaatcagtccacattaatagatttttacctcctccacatctttatgctaaaagttcccttggactcttcagcctgatattagtccagctccataattatctcagagccctcaaagatcctaaggtattagtcaggaagtacaaattaccttattcttgtatgtagatagaagccaaactggaaaggttcccaaaggcttccagacttacctctgctctgaaactcacaccaaaaagaagaaatctgatattggagaaatgaaaacttttccaaggtggtataatgaaataaaaggaagaaagcaattcaagaagcccaatttgaacatctctacatagatgaaactagctcatttgatttcccttctagtggaatgaagtcaaagtctggaaaaagatgagtttatttggggcttacagtaacacttacattataaaactctgacaaactctaaagcaaaaatctctagctactggtaattttaaatctacctaacataaaatttaattgaatatgaaaaagctttcaacttttcttttcctatcttttcttcatttcattaactgatgaaaagagatactgtattagcagttataaacagaaacacatcattgcccactacaattgccctataatttaatcagtacatcttgtagctcatttttatctgtactggtaactaaaatataatccacgcttgttatttgtctaggatatcataataacatgacttcatatgtagatactatattattcatataaaaattgatttataaatctttttctagaaaatataaatgctgaatctttgctaaggtataggttaaacagttattacaaactttgtcaaagacaatctttatagtccctgacatttcataacatgatttatatatatatatatatatatatatatatatacacaacatacaagtgaaaagattaacaacttgagagtgttttttctttagaagaatattttactgcaaaggtagagagccatgggaatgtgtatgagcacattgaatttagagttcaagttctggctacgagatacctgggaaagtaacacacattgaatagtgagaggcaagcatatacctgcctcatcagcagatgaagtgtgagcagaagtcggtgatggaggggaaggttccaagcctccaatactccatgctcaccttcctgcagttttggggttttttttgttgctttgtgtttttttgttgttgtttgtttgtttttaagacaagatcgggctctcttgcccaggctggagtgcagtggcgtgagcttggctcactgcagcctctgcctcccatgctcaagtcatcctcccacctcagcctcccaagtagctgagaccacaggcatgcaccaccatgcccagctaatttttgtattttttgtagacacagggtctcatcatgttgctcaggctggtatccaactcctgagctcaagagatcctcctgcctcagcctcccaaagtgctgggattacagctgtgagccatcatgcccaatctcatctttctgcttttgaatcaagtcctcatggctggcattgcctcagccatcttgatatcataagacaacaagcatgaagagtaaaaatggtcatcattcctgatttgcctgggatcatctaggtttgcctagaatagtcctattcgagtatttgtcctaggtatttcctttcaaataaataatcattattaatagttgcactcaaataagcaaagatgcatttggtagctctctactttctacttcctgcttcctgtttctgacacgaccatattagtagcgtgtgggaatcttatgcaacaattagagctctcattttaacacatgcttaaatctaaaggttagcagtgacctgtctttattgctgacgttcgccaaatgaaatattactcaaatcaccttacagaaacagcaggcagtataattaaagacaaaaagaattacaccggacaccattttctaggaacagaccaaagtggcagtgagagaatgctttgatgctcctgccattccgaccacacattgtaacccccaaaggtgctgtggcccttgctaaagactgcgaaaggaacacagcagacaggccactagtcagagagataagtaaggaatatgggaaaggataggtgaggtgtatatgaaatatatgagggaaatcaaggctgagtgcttctgcctgagaacgaatcaagagaagcctgaggccaagtgggatggctcaagcctgtaatcccagtactttgggaggccgaggcacacggatcacctgaggtcaggggttcgagaccagcctggccaaaatggcaaaaccccgtctctactaaaaatacaaaaattagtcagtcatggtgacccacgcctgtaattccagctacttgggaggctgaggcaggagaatcacttgaacctaggaggcagagtttgcagtgagtggagataacactactgcactccagcctaggcaacagagtgaaaatctgtctcaaaaaaaaaaaaaaaaaaaagagagaagtctgaaatacttgtgctacagtggttttgtcatttattgtgtggtgcaaatctacaattatttatacaatttattttgggaaagctttttaattttgtaaagaacattagttcttaagttcatgtttaatgaaaatattaataccacacttccatttatcatctgagagaaattaataatgaatatgtaagttttcaaagtgtttgtcaaccagggatcataataattactatacctgatcacatgaaaatcagaaacacacaaccactgaggaagaatcagcaactttttaaaagtctggcagttatattatgaagatggtaacggaatacaatgatttacgatgtgaaactggaaatgggtgtttacacatcactctgtggagtgcgactttgcatttacatcaagtgcctgacttctagattaattttatgcattattctattccaagttttcttgtgaacatacgaagagctataaatttgttacttccatttagcaaatgatcttcaaaagcagttaaataatcctgtgtcataaatgcttcaagtagaagcatagaaataaaaatagaaaattagttaaatttaattcttaaaatgatttgaattttaaatctaatttacatatttaaaataaagctcttacaagctcattctgctgaaactgaaacgtgatataatggtaaacactatcgtaaatgtagttaaaatgttcatcgacaaaaaattatttgcttttatggtgataatgtgaatacaagtcttattgtagtatagctttggaataaaatcaatgttcttaatacatgtatttggaagtggctgagatgaattagaattcataactgcatccaaactagtttctagtttcaatattgtactaatattgtagtaatcaaaatacagctgtagttgtcaaaatttacaaatgtgtatgtgtatgtatttatacccagattctcttttttttcttttcttttctttttttttttttttctttgagagagagtctcattctgtcatccaggctgaagtgcaatggcgtgaggtcagctcactgtaacctctgccttccaggttcaagcaattctcctgccccagcctcccaagcagctggaattaaaggtgcctgccaccacacccagctaatgtttatatttgtagaagagatggagttttgccttattggccaggctggtctcaaactcctgacttcaaatgatctgcccgccttggcctcccaaagtgttgggattacagacgtgagccaccgtgcctggccacaaattctctatattttaaattcaaacacatttaaaacatggaaacactaaaaaattaacaacattcaaaaacactggcaaatgtttattcaaagtatccaataaaaggaatgccaaaaaatacactggcttttacagtttggggtcaattgcaattactaggaataggctagaacagaaaaacacgcataagatcaaggaaattggaagatcaaatgtgccttaagatttaatatttaaattctctgtatttagaaatatattggattgtgggaagaatctttcaatagggcttatgtttttcactggataattttatactctgtataagattaaaataacattgagatgacctacaattacatggtgttgaaatttgacaaaataatcaagttttgacaaatttaaatatgacaattttctaatatgataatctgaaaatttttgtccaagaaaattactctgaatcaaggcacaaagatagtatttgtaaaatattttagctgaaatatttattattttacaatatgaaaatattagaagaatatgttccttttagcaaaattttctctaagcttacaggaacctcaacatgtagaaagtgattattgacaattcaaaaacattatttttcatagggaaatgcaaattgaaagagtactaattttgattttaataactatataataaaataaattgaacgtagagtcagatcgtcaaatcagtgccttaaccattcctatatgcagaagcttatttagtcacttcgctttcaattaaaagtgtacttacaatagtattttagtaaaaccaaataggtgcccatgctgttaataaaatactatttaaaatattgttcactttatctaatgcttttctaatttggtttttgttatttttaataatccacataaatgtgtataatttaaaataagtgtacacctgttggatatgcatgtggaaaatgtttttactcatagagtgcacaaaaagttaagtttggagaccaacacaagaaatgtatagcttgtcttctgacactgcctattaggacggaaggacacggctttgagaaaatgattctttctattaagaaatgtccagtcatttctgaaagcactgaactattcactgaccacagttcaagtacagacaaggaatgtggtttccacagtcactgtgagctgtgttttcactataaacagaagtccaagagtagctagtacatgttaaatacagattatggcatttttttaatagctagaagagacgtatgattccctgaaaaggaaagctgaggcctgtggccttgcacaatgttgtgcagtggccgagctagacctacgtctcccaacacatatcctcatgctttatcccaaactgtactggatgccttgttcatagttagctctacttaatagagtactggttaagaatgaaggtataattcggccaggcacggtggctcacgcctgtaatcccagcactttgggaggccgtggtgggtggatcacttgaggtcaggcgctcgagacgagcctggacaacatggtgaaacaccatctctataaaaaatagaaaaattagcagagcgtggcggtgcacgcctgtaatcccagctactccggaggctgaggcgggagaatggcttgaacctgcgaggcggaggttgcaatgagctgagatcacgcctctgaactccagcctggaccatagagcaagactccgtctcaaaaagaaaaaaaagaataaagatataactcatctcatgctaatgaaccttctttctttctactggatttttttttctaaatgttaaagactcttcttgcctttagtttaactggttttggagttagagggtcattgttatttagcaaattattcttattttttaaggaggacgtgaaactgcagtggtttctagagagaaaatagattaataaaacagaagagatttttatttttcatacacttatactttcctttataaaataagtgtccggaagtgagcatttttctcttttatgaatcctgaaggcttgaaaagacttattgcaaaaatgtttacagaatgccttctaataatataaacctgctcattaacacgatgagacttaggacaagaatgttgcaataaatggaatgaaatattacagttttaaaggcattagtctggaaaatttcctatgtgggaaaagcttgctctagcgatacaagcctttacctgggaaaattatctagctgttttctctttttcttgtccacacgtggtgccttggctaaatggtttcataacaagcattacaagcttataagactgcaacattactccccacttccactaccacttctccagccaaaaataagtaatggaaattgaaatatcatccataagggcttggcacaaaagaggagtgtattgcagagtcatttcagaaagaaaatatttactgcccaacgaagtgggcgctgcagtaggcctggctggcatgtggtgggcagtgcagagaactgaaaatgcaccaagaaacgcagtatgaaacttttggctattttgtttttctgtttagattataatatgcaaaagaggtagaatataaacagatgttgaatctttattcatcacattttgctctacttggttttatagtatagtttggccaaagtactcaggtttatcatagacatttctacttagtattaaactctgaaaactaaagtaatgaagctctactgaaaagacttggttatattcttgattaatttgcatggatacagttgtctgagaatacattttaagcacatttcaacaatattcatatcttgaggaacacttactttattaagtgacagatgcaaaagaaactcagatgagactacctcatgctgtaaatctaaggtttatgtggaataaataagtacacattatctttcaatagattcagagctgtgatgaagtaaaagaaagaaacaaagttttaaaagctcagaaaaaccagtgaattttaagtttaccgccctatgacaaggaacaaaatagcaggcttcaattttagaactctaattacttttttctgtatttaaacactttcataagcaaaaaggaacatccttatatgcctgatatcacctatctcagtcaaaatattttgaaaactaagcctcataatgaaacctcattagttcatgctcaacgccaggagtactttgtactttggaagttataggggccgttgttacaggtctattgctctgttgttactctctgaagaatacattcccactggtggaaagatgtgtaaaacaaagataaactcagtgattaaaatacaaataaagtaatatggttctgcatttgtaaaactgtcctgacccatattgattggatgaggcatgtatacgacttgccaggtgtaatattactccttcctaaatctatccttgctgctctccttcactcttcaaacgtttccctttgaaatagaatgagatcatgctgttatgagtcaatgattccccctcaaaaaatgtacacagggctttgggcatattagttaatccaataggtgtaaatataaacaaaacaacactcctaacatgttgatgctttcagtttagtaagtgggagaagtatataaactattaaattataaagcataatgtgataagcccttcggagatagaaacacacaaagaaggaggatgatgaagatatccaacagtggtagaagaaatatgatctctcagatacatcacagccttgtacctgtcttgggactatttaaaccaaactatattttaatatgaagagttagttctgtctcattcctgtctccaaagaacttatatattccctatagctaaaggaaaagctaaaaatcgttaatcttaactttcttttctctggttctttttgttctcaacacagtcaacagttgttttattttattggacatgccatgcaagctccagagatgaataatgttagtcatcaaacatagatataacattaagtcgctctcaaacaaggcatcttctttcgttaataacattctgtaaaaattgtgctttttgaaaatgcttggaaacagcattagcagtttcaaaacaaaactgccagggaagtttattttatagtcaagattacttccatgttaatattcttctttttaaagagaaaaattttagccgagaccagagcaacaacgaaaagcataacataagcttaaacttaaaaaaaaaatctttagaggcttttcatctgttttttgggggggggtttttttgttgttgttttttttaagtttcaacatgaactcatctttctaaggagcattttgggtattatacagcttattttatgcatttcacaagctaaatttagacaattatactcaactctgaatttcagttttataagaacctttttttgcttggtgaggttcttttgagcctcaaaagctgattctcattttaatccctttgaattcttaaggataaaagctattcaaataatttgaagacttctatcaagaatcctggcatttttcctgcagataaaatgagcattcctttcttcccacataccaaacagtgaaggcaatataattgttttctaaacacagattttatttcttctcagttaatattacataattttggcacaatatattattaaatcattgacatttttataaataactatgtggcactatgtatgacatttacacgatacctggcataaacatgtacataaattaattatctattatttaggataattatccattattaggatttgctaagaagatggcatttagctcttcctagcaaagtgccaaattcttgagacaggaaatcatatctaattttaaaagcaacataacaagtgatattaataatcacagtgtctctgtatggtaatcattattactgtcatcaacatcatagtgaatattaactgggaactgagattgagataggcacagttctaagaacttatttctcatatctcaatctttgcagtggtcccatgaataataactattattgtgcccattttacacatgaagaaactaagacctagaaaaatattaaataaatattagataaaccctactaaagtctaagccacagaaattaaatcctacaacctcacattcccagatgctctctatattttacattcaccaaaggtttttctaaaacactttttgacactttttgccttgcagtgtagaagtttggccagtgagcaaacccatattttgaattctaaatatattatagatgataactcagatgacttgtacttttctctctatattttactattagttgaatccaggagaaaacaaaacattatttttaaaatgttgaagaaataaaaaaactgtcaatctcaaatgctatgtccagggaaacatatatttaaagaatcaaggcaaaataaaaacttttccagatacacaaaagctttaagagtccatttctgacagacatgtgttaaaaaatatacacacacacacacacacacacacacacacacacacacatatatatatatatatatagcagaattatgcaatgagagtagataaactcaaatctgcatgtctacataatggaataaaaagtactaaaaatgggctggacatggtggcttatgcctataatcccagcattttgggaggccaagatgggaggttcacttgaggctgggagttcaggaccagtctgggcaacataacaagacctcagctacaaaaaataataaataaatattaattagccaggtatggtggtgcatgcctgtagtcctagctactttggaagctcaggcaggagcccaatcacttgaacccaggaattcaaggcttcagtgagctatgattgtgccactgcactccagcctgcgagccagagtgagatcttgcctctaggaaaaaaaaaaaaaaagaaaaaaaaaggaaagaaaaaagtgctaggaatgataagtatggaagtatatctgctattgtttggatgtgtcccttccaaaatgcaggtgttgccagtactatagtattaggagacggggcctttaagaagtaattaaaccctgagggctcttccatcatgaaggggattaaggctcttataaacaagactgcacacaatgctctgccctcttgccttccatcttctgccaggcgaggactcagcatttcttccctccagacgatggagcatcaaggcgccatcttggaaacaaagagcagccctcaccagacaccaaacctgtgagcgccttgatctcggactttccatcctccgttaccgcgagaaaataaatttccattctttataaattgcccagttcgaaatattcttttatggctatacaaacaaattaagacaatatcttaaaggcattttctcatttcaaaatatttattgatgagataattggtggtttaaaacaaaaataatagcaaaatattttggatttataacatgtatagaaagaaaatacatggtaacaattttacaaagagaaggaggtagaatagaagaacactgttttatggttcttatatcatacatgaagatatatattaagtgaaggtagactgtaataaaatgaatatttggaattctggagcaactactaaaaaactaaaactaaaaataaaatatggttgataagaaaataagagaatggtaaaaatacctaattaacctaaaagtcaggagataagtatataataaagaaaaaatagatgagacctacatgaaataaacaagagggaggacttatgctatcaattacagtcatattcattgcatgaagaccacaaataaaaatgtaaattgtcagtctataaaaaaacaccacacaactatatactttgtacaagaaatgtctttatataaagaaataaataagagtgaaagattggaaaagatacaccaagcaaatactaatcataaaaaaaccaacaactccattaaaaatgggcaaaaggatggaatacttcaaaaaaaaactccattaaaaatgggcaaaaggatgggatacttcaaatgatcaataagctcataaaaagacactcaatatctccaatcttcagagaaattcaaattaaaaccagagtgagataccactaaacaccctctaaaatgattaaaattcaaaagttgacaacacttcctgtaagtgaagatattagagtaacactaagtctcatacactgctgttgaggatgtacaatgatacagttttggaaaacagtgcagcagtttcttaaaaagtaaaacatagacttaccatatgattagcagttacactcctctcctgtgtcgatagtgaataaaaatgaaaatttatgactacacaaagacttacacgtaatgttcttagaagttcttagaagtttttgtttgtttgtttgtttgtttgttttttcacgatcttggctcactgcaagctccgcctcccgagttcatgccattcttctgcctcagcctcccgaatagctgggactacaggtgcccgccaccatgcccggctaattttttttgtatttttagtggagacagggtttcaccgtgctagccaggatggtctcgctctcctgacctcgtgatccgccctcctcggcctcccaaagtgctgggattacaggcgtgagccactgcgcccggccagaagttttattcatagaagtcacagaatagaaacaactcaaatgtccattaacagatgagtggaaaaatacactgtgaatacatacaatgggatacttttcatcttttaaaagaaatgggctattaaaacgtagaataacatgtatgaatttcaaaagctttatgcggagtaaaagaaaccacatatcaaaagttacatccatttatattaaattctacagcaggcaaaaccaatctgtagttgagggttggggtggattgaccagcaaagaataaaagggtttttctgagggatgatgatgattacatgggtttcacatttgtcaaaattcatcaaacgctatgcttaaaatggttgcattccattgtgggtaaatttttcctccttaaagtcgactactttaaatgttaattttaaaatatttactgtcttttgtaaaccactgattccccaactttcatcaattaacgcttaagagaaaagggattatagccatgaatctcagaaaccatacattagccacatgcctatatacatcaaataaataatttacctactggttaaaaacgaaatcatttacttaagttattaatttgaagttctagtgactcaaacactctaaaatataacccaaatctgaagaggtaggaaaaattacatagactatattcatttcaataaatgttggcactataattttcgagtgataatgttctaacactaaaatgtattttgttccagggcatgtgacagtgtttgtttttggttctaaaatttatggggtgtttgaaattaactagctcaataaaaataaatataaaaaagaaattaactttctataaatgctttcagatactctttcacagaacgcgagggtaataaaacaatcacatttaatttattttccttccatttataatgctgaagctctcatttatgcctccagtcataacaacaaattgtataacaaatcaattgcttcatactgactaggttagcttgaaagtgtagccccatttttgaaattgccacctacaactagctaagccagcatgtatatccttaaaaacaataatgataaaattaaattgttgttcaaatccctaccttatgttcaaaggtcacaaccaagcacagaattcgaaagttaatattaagaactgtttgttatttaagaaggaataataatctctcagtcttatttaattccctatgcatatcttgactactttaatgtggatgatatcattactaaaataccctctactctaggtattgcactttagagcacagtaatgtgatttaattctgagttccaatagcaaaacctgatgtttggacagtgtgactcatcaatctggaattacctgttctactgcttcaaaagagccttcccttcaccttcccacctctctacctctgaactcttaggtggcaggtcccttagacccattgaatttggttatctcagctgtcaggaacttctcactcaactttgaggaaagagaggcaggacactgtttaaggaaatttacagcagccaaaagtacagactgtcaatgtccaaaaaagaagttacccaaaaatagtaaagaagtcctgcccagctgaatattctgtgctttctctactgccacctctaacccattaaaagacttagatttctaaaaccactactggaacaaaagaaatactcagaaaaattagaatttaaaaaaatccccattttcaataccaacatactaaaatcaaatatattccttatgaagaaaaatacaaaagagaaaatatatttaatacaaggaataaaatgatttgaataaatatcatattcctgaattcaaggactcattaatataaagatatcagttctcccctagttaatctatcaattcaatataaccccaataaaaattttataattttataagttttgtaaaacataacaagcaaatttatagtggatgttcaagagtaagtgttctagactgccaaagaataataatcaaaaagtgcaaggagaggggatattgatttaataaaattaagaaagatgttaatttgttacagcaattgtttgagttttaaaatcaatgaaccatgaaacactatgcaataacttgaatagaatataatgactaaatatttagtaaaaaaaaataaaaaaaattaaaaaacggccgggcacggtggctcacgcctgtaatcccagcactttgggaggccgaggggggtggatcatgaggtcaggtgatcgagaccatcctggctaacacggtgaaaccccgtctctactaaaaattacaaaaaattagctgggcttggtggcgggcgcctgtagttccagctactcgggaggctgaggcaggagaatggcgtaaacccgggaggcagagcttgcagtgagccaagatcgcgccactgcactccagcctgggcgacacagcgagactctgtctccaaaaaaaaaaaaaaaaaaaaaaaaaaaaaactatacattcctgttatataataaaattaaaataatttccaggcatacctttccttcattgcactttcctcaatgtgtaactacatgcattaaactgcatatgtgatgccagtcctttagcccactagaacatagttacccagagagcagttgggattgctctacattgcatctgacacaaatcctagcagcctgcaggcattcaataggtattttatgaattcataaataaataactaaatgttaaagcacacttaagagatttagcaacatttataaaagaatatttcagaatgtcaagatatgtaagtataacctaacaagatatcaaaccagaagcaatactttttaaaaattgaagaaaaaaaacccataaaaacgtaaagcatctgtagagtaaaaataccataaagctaaaagataagcacaagactcagagaaactacgtggtaaattgtagtggggggttcatatccataatatatttagaactcttaaaaataaataataaaaaggcaagtaagtaaataataaaataaggaaacaatataaacaaagaagtcacaaaaaataaaaatgtccagtaatatgtgaaaatttttccttcatcttgactattgtggagtttagagagatggaagatcacatcaaaattaaaacaaatgtaaattatatcttttcctcagatacctataaataagattgatgttttccagcactttcaagggtacagacaacagaaaccactatttcttttattagaattaaaaatgggagtagttttgggagatggcaatttatcaaaatattaaaattattaatgtgcttcttctttgacttagaaatttcacttttagaagtctacttactctatggaaatactgacatatgtgcattcaagggcaaacttttcattgtagcattctttgtaaatagtaaattaaaaggaatcaactcaaatgcccctcaattaaatacactagtttacatacatattatgttgtctatgcagtctttaatgcactttaacgcatttaagatgcaaattagttctatcaatatgtacctctatgaaaaaacttactgaaaatataaatctaaaactaagttacagaacaagctgcatagtgtgactcaattcatgtcataaaagtatacaaaagtttccgacatgtacaaatggagctgatactctgcatgaaacatagtacttaaaatgtttgattaatgaatgaacaagtcaatgaataaatagaatgaaaccttaaagtatccagcatgttgaaaacagtgatcacctatgggttggagagtacaatgggagaggtgaaatgttgtaaggatatgaaggagactattctattttatatatttacttgaattttttaaacaagttgcattcacaatgttgaatttaaaattaatttaaattaaaatataaaaaagatctggctattagaaaaatattaaagtaaaaacacaaagttgagagcaaaattaagctaaatgaatagtccatttttacaatgaaaacaaaaagcacctaaattacaagtgccacttagatcaaaagctgaaataaaataatgtaattaggctagtgaggtgactttctaccaccctatttaattctaaagttgatagtcagttatttatatggacgtgacctcaagtgaatggattacatagagtttgagtgttaactttctatatcttaggctcactctcaatattttttagataaataatttattacattattaaaatgattttgacattggtcaataggtacaaacataaagaaaagaaataagttctaatgtttgatagcagaatagggtgactatacatagcaataatattttgtacatgtcaaagtaactaaaagagaggatttgaaatattcccaacacatagaaataacaaatactccataatggtattgctgagtcaaatggtatttctggttctagatccttgaggaattgccacactgtcttccacaatggttgaattaattacactcccaccaacagtgtaaaagcgttcctgtttctccacagccgcgccagcatctgttgtttcctgactttttaatgatcgccattctaactggcttcagatggtatctcattgtggttttgatttgcatttctctaatgaccagtgatgatgagcttttttttctgtttgtgggctgcataaatgtcttcttttgagaagtgtctgttcatatccttcacccactttttggtggggttgtttttttcttgtaaatttgtttatttcttgtacataatccttaattatgtaaggatacataataacagattgtagattctgggtattagacctctgtcagatacttaaagtaaaataaaaatttttttaaagtaaaaccaaaaaaaaaaaagaaatgacaaatactcaaggtgatagatattccaagtaccctggctttactggctttatcattacacattctatgcatggaacaaacacatatacctcataaatatgtaaaatattatgtatcaataagaaatgggaaaaagactaaagtcaactgtgattttagaaacaaattacattctaaggtttcaccaaacagtgttacagcttttgccaaaatccataatcaatcttttccttaattcattctgtaatttaaatgctatctagtaaccaaaagaataatgctaaatataaataaacaaaaaagggtgaaaactggttttgaaatatgccatacctaaagatgtgaatcctgtttataattgccaattaagggtatctgcatagaagtctaaattatatcgatcacccctctggactagagtttgaattcagaatgaatgcaaggaagacccagtattgttccagcaaatacaataaatactactcagctgctgcagggccaaagagccctgagggggtaaaacaataggcaagctcgtgtagcagtcttcaaatctttgtctacagtttcattcctggagtatttagaactgtgaataatttagtaatctgtacacttcctgatgtaaaatctgttatctgaattaagagatttttgtatctcttaaagcagtacagctacatttaatagaattatgctttcctggctgatttacatttgctgccagacaagttaaaagtactaaataaaaatccaataaatacatcttccccaattaaagagaggccactcttcaccaatttaaatggcaattaaatagttcactaattttatagctgtttcagttaacaacataatataaccattatatgtgtccattaactgtaatataagcctaccagatggaaaaagtcagaagaaaattcagctagaagttaaaatgtattttgtaataaactacatatgaatgaatgtatatggtgacctagaactaggatatgatgactttcaacagaagcaacaagaaaaagttaaatcctaatagcaggaaatttttcaagtttttattttgcatttatctgcttcactcttaataagcaaaaaaaaaaacctgacatttggcaatcataagtttttccataagcacaaatagaaccatagcgcctggttccagactacatataatatttctgagaaaatgcatacatgccatgaagatcttaacatgccagttaaggaagaaacagagaaacataaatagtgattaaatagtgatgcagtagttcatttattattttataatacaaatatattttgtatcaggactggttttaccaatgaaattaaaaatgcctggtagactagcaataataaaataggtaaggtgacttggagtcaggggagtcataaaagcaccgtacattgattctttttgaaaatgtgtgtatcttctcatgttagccaacgtaaatatgattcagatatgtttgggagcagcatcacaacaatctacaataaaaattacttttaacagtctcacagaaaacttacctataggtttgggaagtgttatactgtaattttatgagaaaaataatgcattttttagtttattatcaaatattttacttaggcagaaagatagtaaaatatattttatttaagaatagtaataatagcactatcatattaatcaaaatgcaaagaaaagtttaaaaatttctaatactctaaaagttctattgttgattaaaaatttgttgatatttcatttataacagctgctctgctatgaaattatagtaaaagtgaatagaaatacctataacattttttatatcttctttatttcttctcccacgtccccccgagatggagtgtcactctgtcgcccaggctggagagtgcagtggtgcgatctcggctcactgcaacctccgcctcctagattcaagcgattctcctgcctcagcctcctgagtagatgggattacaggcacatgccaccacacccagctaatttttgtattcttagtagagacagggtttgcccatgttggccaggctagtctcgaactcttgaccttgtgatccgccagcctcagcttcccaaagtgctgggattacaggcgtgagccactgtgcccaggtatatcttctttaactacgttggcacagttaagttagaaatactgaaataggagctaaaaagccagattaaactctggctggtcttccatttcatggcaggatgttgggagaaattactagtgtccctggcgtacaggagcttaacaaacattaagaaatactgttttttactaagtgatataaaagattcttcagactttcaacacagggaattttaatgtttattttatccatagtttggaaaatgtgagtgctcaaatactggtttctggctcaactgcttagtcacagaaatctaacaatttcggtttctaaataatgaacatcattttaataatgtttttggagagaaaaaattgttaaatgcatattaattaatatgttagggataatactagagacgtctcatttgtaataagccttcatcttttaaaaaaaatttattagttattttaacatcaatccactttagaagcttattttcttttttaaaaaaattatactttaagttctgtgatacatgtgtagaacatgcaggtttgtcacataggtatacacatgccatggtggtttgctgcacccatcaacctgtcatctacattaggtatttctccaaatgctatccctcccctaaccccaccacctcccgcaacaggccctggtgtgtgatgttcccctctctgtgtccatgtgttctcattgttcaattcccccttatgagtgagaacatgcagtgtttggttttctgttcctgtgttagtttgctgagaatgatggtttcatccatgtccctgcaaaggacatgaactcatcttttttatggctgcatagtattcaatggtgtacatgtgccacattttctttatccagtctgtcactgatgggcatttgggttggttccaagtctttgctattgtgaacagtgcggcaataaacatacgtgtgcatgtttatagaagaatgatttataatcctttgggtatatacccagtaatgggatttctgggtcaaaggtatttctggttctagatcctagaggaattgccacactgtcttccacaacggttgaactaatttacactcccaacaacaatgtaaaagtgtttctatttctccacatcttctccagcatctgttgtttcctgacattttaatgatcaccattctaactggcgtgagatggtatctcattgtggttttgatttgcatttctctaatgaccagtgatgatgagcttttttaaatatgtttgttggccacataaatgtcttcttttgagaagtgtatgttcttatcctttacccactttttgatggggttgtttttttcttctaaatttgtttcagttccttgtagattctggatattattcctttgtcagatggagagatggcaaaaattttctcccattctgtaggttgcctgttcactctgatgatagtttcttttgctgtgcagaagctctttagtttaattagctcccatttgccagttttggcttttgttgccattgcttttggtgttttagtcatgaagtatttgcccatgcctatgtcctgaatggtattgcctaggttttcttctagagttcttgaggttttaggtcttatgtttaagtctttaatccatcttcagttaatttttgtataaggtgtaaggaaggggtccagtttcagttttctgcgtatggctagccagttttcccaacaccatttattaaatagggaatccactccccattgcttgttttttgtcaggtttttcaaagatcagatggttgtagaagtgtggcgttatttctgagggctctgttctgttccgttggtctatatatctgttttggtaccagtaccatgctattttggttactgtagccttgtagtatagtttgaagtcaggtagcgtgatgcctccagctttgatctttttgcttaggattgtcttggctgtacaggttctttttttgtactatatgaaatttaaagtagtttttttttctaattctgtgaagaaagttaatggtatcttgatggagatagcattgaatctataaattactttgggcagtttggccattttcactatatagattcttcctatccattaacatggagtgtttttccatttgtttgtgtcctctcttatttccttgagaagtggtttgtagttctccttaaagagcttcttcacatcccttgtaagctgtattcctaggtattgtattctctttgtagcaattgtgaatgggagctcactcatgatttggctctctgtttgtctgtcattggtgtatatgaatgcttgtgatttttgtacattgattttgtatcctgagactttgctgaagttgcttatcagcttaaggagatttgggctgagacaatggggttttctaaatatgcaatcatgtcatctgcaaagagacaatttgacttcctctattcctatttgaataccttttatttctttctcttacctgattgccctggccagaacttccaatactattcttgaataggagtggtgtgagaggatatgcctgtcttgtgccggttttcaaagggaatgcttccagcttttgcccattcagaatgatattggctgtgagtttctcataagtagctcttattattttgagatacattccatcagtatctagtttattcaaagattttagcatgaagagatgttgaattttatcgaaggccttttctgcatccattgagataatcatgtggtttttgtcattggttctgtttatgtgatggatgatgtgtattgatttgcatatgtttaaccagccttacatcccagggatgaagccaatgtgattgtggtggataagctttttgatgtgctgctggattcggtttgccagtattttattgagggttttcgcatcgatgttcatcagggatattggcctgagattttctttgtttgttgtgtctctgccaggttttggtacgaggatgatgccggcctcataaaatgagttagagaggagtccctctttttctattgtttggaacagttttagaaagaatggtaccagctcctctttgtacctctggtagaattcggatatgaatctgtctggtcctgggctttttttggttggcaggctattaattactgcctcaatttcagaacttgttattggtctattcatggatttgacttcttcctggtttagtcttgagagcaatgttcagaaatttaaccatttctagaagcttattttcatttcgataacaagtagcagacaataatagatttaaaattatgtaccaatgtctttttcattatatgtggtaataaagtgccaaaaaacaagctacaagctgtttgtggcctaagatatgcaaagaattaatttttgtgctggcatatactgtaattagaaattgttctgtgcatcatgattaaaccagtaactatggtaacgagagcaggaaagcatgagtgcaaaaggaaacagcccgagtaagtcagggataagctgcatttcatctttctttttaagtgtttgtaataaacagaactatctataaaatgcatactgatttttattccaattcttatcattcatttacatagattaaaatacattattccttgaacatatacacacacgtacaagacagaacagacacagattattaccacatatggagagcatacagctcttaacagtattatcaggggaataccattacaatctctgcacatctccctcattttcatagggctgtatgaagaaaatgacggagcagaacactcaagtaagaaatctacagtttctggcttttgccttttggccacaaattttcagcaaaactgcttgactcttagtggcatggacgacaaattcagattagcaggcaacagacatgaatacaaaggaaaccagcgcaacactattcctaataatgcgttttgtaggctttaccgactgcagtcttcaacagacataaatacagacgtctcagtttcagagacctcgaatcattagtcttcatgtacatttttttgttttttgttttttgttttttcggtccccaaaccatcaagtggtatgagaaataattagagcagtttcaaaggagaagatcagtcaaaactgattaaaggtttaaaaagtaagccttttgagaaaagggtgttttttaaaaaaaattattcattgaggctagaaaagactctgtgacgaagccaagtacgtgagtgtgaacagcaattatctcactacggaaaacaaagcagaatgaaacaatataaatttcagaaaaacaatcttaatttctggaataacttcttactgtacagatataagaaactgcacgtatcactagataagctgtgtaatctaattgaatttattaaaggagatgaacaagcatcatgttcttgtttagtacaaacaaatatttaatttagtgtttccatagtagagtttctctataaagaattgtaaaactttttaaaaccccatctgaaacagaaataaataccacctggtatcacttataagtgggaactaagtaatacgcacccatattactcagttgtaaataatacacacccatattacttagttgtaagtaatacacacccatattacttagttgtaagtaatacgcacccatattacttagttgtaagtaatacgcacccatattacttagttgtaatataacttataagaaacatgttatataagttgcaagtaatataacttataagtaatataagttataatatatgttataagtaatataacttatattacttgtaagttatattacttataattaagtaatacgggtgcatattacttacaactcagtaatacgggtgcatattacatacaactcagtaatacgggtgcatattacgtacaactcagtaatacgggtgcatattacgtacaactcagtaatacgggtgcatattacgtacaactcagtaatacgggtgcatattacgtacaactaagtaatacgggtgcatattacttataactaagtaatacgggtgcatattacttagttcccacatataagtaatggacatagagagtgaaataatagacactggagacttagaagactaaatgtgtaatgtacgctatttggatgctagttacattagaagcccagacttcaccactatgcagtatatccacgtaacaaaacagtacttgtaccccctaaatctataaaaaatctataaatttataaaaattaaaaaaattaaacttcattcgaatgtaaagttaatgaggaagttaaattatttcaaagattacaaattgagtatcaactaagacaaggcaccaaaaacaactgagtgtttcaggaaaatttttaaacaaataacactgattagttaatgttcctatcatcttccattcatttattcattgtgccaaccaatatcaagcacctgccttgtgtgaagcactgttctagggtctgggtcacaatcatgaaaagatgcataaatctctgtgtcatgtagcttccattcttctaagggagacagacaaaaactagtagaaaataaattacactatttagatgatggtaagagttctggagtgaataaatgggtgatgtgatgaagatgaactgtcaaagcctacttttctaggtgggtcagggaagacgtttttgaggcaggtggtccatagaagccagcgatgtgaggcagagcatgtcaagaacagggaaccgcaagcacagctgtggagtgtccgagggataaagatggcagcagcccaagcactgtgggcaagggcagggcaggacgatgccaggctacagaggtgggcagaggacagacaattggggcctggtagagcattctggggcttggatttttaaaatgcctttatcctaccatcacatttcagtgtttctgatttggggagtgatttataagaaaggtgcctttaagaaaaaccaaaatatgcttattcacgcacaacttctgctcaacttcctgagaggaagccaaaactggagattactgctgtactggaagccagatcaaaaaagaaagcaaaatcatttaagagcctgcatttgaaaatgcttcatttataggatgaaatgaagtgtgtgtggctttcttattgctttcttcaagcctagatatattaatcatcatcttcattaaaatccatttgatgccataaaaggaccaaataattttctttctaattttcagaaactgagtgctgttatataattttaaaatctaactacagagtctttaaaaaaaaaaaaacactagctcgaatttcctcaataattctggctattcgtttttcaattcttatgtgtttattttccatttgaacatttagcattagaaaatcttcctgtgatttccacagcaaccactagagggaaaacttcgactgaagaaagtcatttaaagacactatcttaataatatttcttaagtacaatattaagtataatatttcttaagtctaatattcttaagaataatatttaagtctaacattcttaagaataatatttattaagtgtaatattcttaagaataatatttcttaagtctgaagaactcaaaaataatgatgtcttcaagataaaatattataaaagcacatcataaatcccacatgcattttcaagttattcctgataataatgagcatttgtgttgtaatacgtattctgcaaatgttcttgcattcattacctcatttgtttctccagatgaatggctaatagagcaggaactatgatcactcagctaaaataaaaaaacacaaataatttaaccaaagacacccgacattttaattgcacaatcaatattactactgagggctgagtatatttttcaagtacactatgttgtctcctcactacttttttcaaagaaaatatgaaaatattgtgttctcaatttcctcatcatattctagattttttagtaaaatacctagaacacagtaggcacttgataattagtgaatgtatgcatgcattcatatatgaataaaaagatgaatgaaggaacaaagccctactttttttctatgcaacactatatgccaacatagcacctagcaatagcaatagcaatagcaatagcaatgtgttttccaaacacatcccatttcagagttagtaaatgcagaggacacctgaagataatacttgcagcttaataagtgctacagagaggacatgtttttgtgattttttgctccaatattatgataccctcatgttatagacaggatgtgtccccctgaaagttcacatgttgaaatcctaaccctcaaagtgatggtattaagaggtgagacctttgggaggtaattaggtcatgagggtggagctctcataaatagaattagtttccataagaaaagacatgagagaaatgatttttctttccttcatagaagaatacaatgagaagatggccatctgtgggccgggaggagggccctcgctgagaacctgaccatgctcacaccctggttttggacccccagcatccagaactctgagaaataaaggtttgttgattaagccccacagtctattgtattgtgttacagcagtccaaactaagatgccacatctgattctacctcctttacattgtttgacttttgaatatttgaactctaaaattatgatcaatccatcaaactttatataattcattatcgtaactcaaaaacacaaatatatcatatgggttaatacaaccacataagaaatcagaaaatgctaactggaagtgagaagaattataattgtgattctgtcttttccttctgcaggaatcctgaaacactggccacaaagttatgctatggactcatgcccctacgcagtaaaataacaatgttaatactaacttactatcaattgttactagattgagcaaagaacaatcattaaaatgccatagatccttgaaaacaagcaataatttcctgataaagatgagatacttttcttattctaccaacaagactgcatttggtggtaagtgtgtgtgtgtgtgtgtgtgtgtgtgtgtgtgtgttggggggatgtggtggagggatgaggtagatttggatatctcttttcccacagttgaattcccttccatgcaactaagaaatcaaaaaaagctcctaaaatgagtagctaacttaaacattcacaaaatatttttaaaagaaatactcagaaatatcaaaaggagttatccatgggtagtgtgataagaagtaattttaatgttctttttatgtttttatgtaatttctcatttgtttgcaatgaaaatatgtatatccttttttaacaattgggaaagttttttcactaaaagtcaagtttgtttatttttgttgttgtttttggtggtggtggtagagacagggtctcatggctgtgttgcccaggctagtcttgaactcctggctttgaactcttaactgcaagtgatcctcctgcctcagcctcccgaagtgctaggattacagaccttaaccacaacacctgaccaaaagtcaaagtaatataaattttacattacatcttaaaatcatcattaactgtgtttggcatatattttatgtaaaacaaatatgagtttgtttgattttttatctaagaaactaaataatcaagggctgttaagctgaaccatagctaatactccttgcatcttcttatcaagagctaactttagtaaagattccttcaaatcagtaaataaatgaggttgtctttggctgatactttcagagtcctcagaagtttgattttaaactcatgaaaaagataaagctgaaccgacaggctttacagtcttgttcattcttcacatttagtacattccttgaatagatggtattgtcaacagcttgtttaaaaattgtctgatatctgcgctaagttgtttggatgacaattcatgaaaccaaatagaaaataaacactgtagccttatgagttctcaccacatattttcaataaattttacaagttcatgagtgaagaaagataaagttcttagtaatcagacaatgtataaacaccaatggatcacaaacatttttgtaaagaaaataaagtaaggacaccctcaaaaaatcctaaaagcacacaaagttctccattaagaaagcaattcattttgcaatgaatataaagggaaacaaaattatatacactttgacaaagttaatatatttctttctactgtattgtgatattttaagaactctatggcccatccaaatgcagatgtgtagttacatcattagaaaagaataaataaaactttattagctatgggtctaacagagtctcaatgagacataatagatgtttatttttattcaatttttttacattattttaatggctttattaattaaaataattacaaaagtgccattgattcctaagacaagacattccaagcacataatatgttctatacaactggatataattttgaaatgtgaaaataagaatataatacttgtgaattatttccaactttcaacaaaacttaaatattccaggtttaaccatgactttccaggaaaggaattgcaagatgatgtctggttattgaaacgtgcttcaaaagtggaaaaaagtagctttgggggagtttttacatttaactttactctcaaaagaacctaggacaatctgctgcagtcaacagattgggcagtgctattttttgctgtgcctgagtgtgctggcaggggaaatgaggggacaaagtcctcacttacatttagagaaatgtattattttcatgaaagtatttttaaatgacacacaatagttctaaatgtcatgatatttcttgtcaccttaaatgattaatagcaagaattctattattcctacagaaattatcagccataatttcaacaatgttaatttctgaattatcaaaaatatttagttgagtaagaaagtagagctctgaaactaaaaatacttacaggagcagagataatactaaatgttaaaatatagtatttgtaagacttttttttttctcccatgaatatttagaaagcctttttggttatttcaggcttctgttatactgaatgccacccattccaagtgaccactgggaaagggaatttcatctctgcaacctagaaattactactcttaaatacaacacgtcgataaataattggaaagcttcatctatcatcctgcctactgaactccccatggaatgaaaaacgtcaccttctcaagatgcttatctgcccaactgaccctgtaacaagccatttttctttataaatagtatttcatgtgaaaatactacttttagtaggaaaaatgggtggaagaaccatacattatgattttttaaatctgtggatatagaagtgaagatggagataaaacagtaaaaatagatattgattcccatgatgtccatatgattaggccatgaacagacagaaaaggaaagagagaggatagagttggacaagcactggcctataagtccgaaatttctggattccatcctcattacctctgacggcgaaataatctcttgaggcttcagtgtccttaactaaaaatgaggggaataccatctaccttgaaaggctgttgaagcaatgaggctttaggcatttaaagcaactagaatacgcacagttaataagtaatagctaataagaaatatgaatgaattgcaacaattttctgaaaaaatatctggatttatcccagaattatatagctttatacaagtcaaggcttcttcacatttatattacctgggtagttaatggtattggttaatgcggagcgtgtttgtgaatgagataagacttaaactggtaaacttttcataagcagattgccctgcataatgaggtgggccccattcaatcacttgaaggcctgaatagaaaaaaaaagaccagcttctctgaacaagagggaattctccagcagtctaccttccaactttccctacaccatcggctctcctgggcttgcagcctgctggcagccatgctgcagactttggactcaccagcctccataatcatgtgagtcaattccttatgataaatctccttccacacagacacacattctgctgattctctttctctgcagaaccatgactaatacagtgatattacaaggcccaggtgaccaaatatctcagagacaagtaactaaaacaaatacctcagagacaagtaactaaactttccttttcaagagtcaaaaatctgtttgactcttgagagtctttgacttttgagaacattcttttatgtttgaaatattcaagttaagatactatattccttaagaagctaggagaagttcgtttctatgtacacttcaaagctagatgtccaaggagtctagtggagttctaagctgcataatggattcccatgatggattgtagcttaaggtagtgatctcagaatggatgtccccaaagcaatggaattaacatattattcagttattttcccagttgcccattgtaacaaggagcggaggctacagtacctccaccttcttagggtaaggattgttgtaagaaaaaattttaaattcttccatttaagcaacatgtaactaggaatattagaaagcattaatccattcactcattccagagatatttttgtgtacatctttcctgaaaatttttgtaatacattttgtcccagagcccacaaaatcatataataaaatagataatgagccatcctgtccaccaatgagtccagtcctggtgtattacaatgcccaaagaaagcagaaatccggtgggggcatgggaacttgggcctgtaatctcagcactttgggaggctgagatgggaggatcccttgagccccacagttcaagaccagcctgagcaacatggcaaaaccccatttccactaaaaatataaaaatttgctaggcatggtggcgcatgactgtggtcctgactacttgggattgcttgaccccagtgggtagaggctgcagtgagccaagatcacactactgctctccagtgtgggcgacagaacaagaccctgtttttaaaaaaaaaaaaaaaaggagagaaaaagaaaagaaaaacagaaatccccttgccttaaaagttaaataatgggaatgttctactttgattcaagaatagagcatgcatgcattctacatatctaaaatcctaaattttataaaacaaataaagaaatcaaagggcagggaaattttattctatatcaaactgttccaagaatttgatagtttttgaagctgaaaaacctataaatacactgtgttggaacctcggctgtatcatgacaattttccacagagaagtagtctaagggaaagtaatttgtgtaatagatgtgaaaatgactccggaaatagcatttgcagacctaaactgtatccattttaagatatgtagtacaaagaattaggaagaatgcactttctaaccacaaaaagagtagccaattgcctgtaaagcagtgtatggcagggatttaattgatatttgcatgtcattatttttagttaatatagtattattgctttgtttattatgacacattacacaactttgagttctgcaggacacatggcagacttataatgtatataaaaactaccatggaggtcgggcgcagtggctcacacctgcaattccagcactttgggaggccgaggtgggcggatcacctaaggtcgggatcgagaccagcctgaccaacatggagaaaccccgtctctactaaaaatacaaaattagtcaggcatggtggcacatgcctgtagtcccagctacttcggaggctgtggcaggagaattgcttgaacccgggaggtgggggttgtgatgagccgagatcgtgccattgcactccagcctgggcaacaagagcaaaactccatatcaaaaaataaaataaaataaaataactaccatgggaactattaaaattgagttagaaatgttaacccagttggtttaaaaaacatcttttttttacagtcctgagaaatgctgacagcactgatcactgggtgatagaaatttgttcaattacatgtccttagcttttcttcctggcccgctctataccttgacttttcctagagggcagtatagtctagggctgagctgtctgagaaggtagacactagtcacatgtggctatttcaatttgaataaactaaaattagatgaaatgtaaatgcctttgctcagttgtgctgttcacaatccaggtgctcaacagtcacttgtggctaaggctctggtattgtacaacagagatctagaacgttttcatcatctccatgagttctactggacagcacagctctagtggctaagggtgtggcccccgtggctaggttgtatcagtgcgaaacccggctcaagcactttagaactgtgtaagcttaaatgagtttccttgtctttctgtgccccagtttcctcacctgaaaaatgaaaacactattagagttttaattaaaatgtgtagagtactgaggacagtggctagcaaataatatataccacactgagttttgtctatcatttttccacccgaagagtcaagccaaagcaaaagtcttaagaggtctaaagaggagtgaatctgagatgatgagttagaccatctctggagagacaatggaagtcatcatttctgttttcctttcagtgaggttgcacccgtgtcttagcctttgtagtccagctacatccctttcacagggcctcatatctgtcttttccatgggtcttaaacatgatttggacttggagtattttctacatatctagggcaagagtagaactttaccctggctgcctgatggcaaacagccaaaccttgtagtaatggaacaaaagagagatagccagggactacagtaaattaacagcagtgctgagaaggtactacaggcgctgtgagggcctaataatacttaagtcaaaggaccagacaatgacctcaaacacagataaaacaccctgtgtctacttgagaatccaaaacaaattccatgatttttcgtaagagtcctgagaagtagagatgaatcaccctattctccaaaacacaatacctggaagaaaagtcccttggccttcgccacatagataatccatggctggacgaagcctgcacttgacctctggacttttcaagccagtgctggagatgagaagcaattccatctgttccaacaagcccacataccacacctgttactggggtccatgggagaaaggaaaatctagtaagttcatttgaaggggtagcttatttcaatatgcggtgtcctttgctttattcaacaaatattcaatagcaaatatagaatatgtttacaaaaatagaaaatggtagactatggaaccaggaaactcacatttaaatcccagctgcataagtttctagcttaaatactcacttcttgggattttagtaggactggaacaagctaatacatgtaaagcattaaaaatagtgtccagtatgtatcacatgttcaaatacaatgttagctatcatatattttcatcagtacagaggtaagacaaaatcttttcaggaagatttattttcaggttttcagttttatttatgagtatccaatctatctctggttcacctgactgtgacatcatttggctctattcttaatcagtaataaggaataacttcattccaagcagtaacaacagccaaaacaaagctgtttggctccatctgtttctactgatggagcttgcttcaatcactgtaatgagtaaacgatccattcctgaacatctagatccagtgttgtatgaagcagggttttggagagctgtgactggggacatggtagtatgctggagctggctctcatggtctatggagagcccattgtgtgtatctctttccagctctgccttcagtgacgttaaaattagcttttgtggaaatagttacaccttgaaaatagacaaatactcgggtaagggctgaaccctcaccagagacccagttgtaaaataccaacatgctgctagggcaaccccaaataggtcccacagaattccatggatgggcgccatagtgcacgtgcgtcgtacaaaaccgaatgctctacaatatacattagaagaacctcttgaggatattggtcatcaaaatttaaaaattcctgttctagaggagccattagccaaatttctcttggatataccagaaagacacatgttctgtcttcattttatcctatggacaacagactttccctcttttgatggatgttagagaaattatagataatttttgagccatcaataaataaaatgtagggcttaacaatacaaattctgtgtaagaatctcaccaaagcgtcacctaatttttctacttatatttcatttgctcgaattcatatcactatttctatttttaatctcttctttttatttgtttatactcaaatttatgttatctctggtaagtacagttttacagtaagttttaaaccaatagttaagctgttttaatttggttctgtcaaattccaaatgatttctcagtcaaataaaaatttttgaagtacttagttgaagattcaatgagataagaagccatctaccagttaaaaagtacacagaggtgttcaattgattcagctcaattggaaggtacaaaagaaagttgattaatccctcctctaattctaatttgtaaatttttaagtattcatttcaactgaatactatgtccctgaacaatttaatgtaattttaatcccaattgtattttaagaaagaaaaatacatttttaaatagagttggagaataaggacaatttggtacaagtaagaatgtcaaggcattcattattctctaatataaacatgagaataaaataaactatgtattctagagtacatatagtcagagattacttcacaatatttcaatgggaaagtaaacagaaattactcaatattctctatcaaaatacagcctatcaaaatatatttagcaattgttcatataagcgtagggaaaaagacagaaaaatatatttttttactagaacagcttccaaaaacacccttagtttttcggaatgtgcaccttggaaatgttcagactgaatgctcaggcttaaaagcaggctggcaaatgaagttacaacacatgaacaggtgtgttttacccactattacagcctcttatctcagtgggtttctatcagttcttctccacccacaccacttactgaacaaaaattctgtgcttcacactaagctaagagcaaaggcaggtaagaaagccatatacgacaagggtacctgctctcaagtccattaattattttacactttaattgaacaaattcataggtaagtccctaccatgtatttatgtaccaggcatgcaacaagatgattacagtaccatcattctcagcaaactaacacaagaacagaaaaccaaatgccacatgttctcactcattagtgggagttgaacaatgagaacacatggacacagggaggggaacatcacacagcagagtctgtcagtgggtgggtgggtaggggagtgatagcattaggagaaatacgtaatgtagatgaccggttgatgggtgcagcaaaccaccatggcacgtgtatacctatgtaacaaacctgcacgttctgcacatgtatcccagaatttaaagtatatatattaaaaaaatcaatagtaggttctcataaaaaataagtaaataaagacaaaaaataaagttataaaaacatcataatttttgtttgtgcctacctttgtaacattaatgtaacttgtaatcctaacatatcaccgatatttcacagtttctaagtaattgctttgttctgttttgttgtttgttttttgtttttttgagacggagtctcactgcaacacccaggctggagtgcaatggtgcaatcctggctcactgcaacctccacttcccgggttcaaacaattctcctgcctcagcctcccgagtagctgggattccaggcacccaccaccatgcctggctaatttttgtgtttttactagagatggtgtttcaccatattggccaggcccgtctcgaactccttacttcaagtgacccgcccacctcaacctcccaaaatgttgggattacaggcgtgagccaccatgcccagcctgtttccaagtaattgtgaatgctggagagcattgcctattttgctttcctgtaaaatattagttgggccatataaaatacttgaatggcatcattcaccttcaaagtactttttaaatggtagccaatgaaagaataaaatctccacaaagtttaggaaaccactgttgattcagaggcatgtttactgttccactctgtagcattaggttacagatgtgcaaattatgattgtatttgaagtgtattttcaaagccactacccttgagaaccataaagccactttcaacatctgtctctaaattcaattgctaactgatagggtgacatgtaaaaatggctaaaactgtattctaaacaaaggtattggtcttccccccattcattgaccaggaggacaagtttcctcagatctctagaggtctctggagaatgcttgcctctagacactttgagtgtatattagcagtccattaagcctgaatctagatcacatcttgaaataaactagggtgtgatctactcacatctgtgttatctacattgccacagcactaaggtttccaaaaggaggcatagtttacactaaaagaaacctttttggtttcactcaacaaaatcacagtttacactcttactgctgcctttacaaaaagctactcagatccatttccattcccaccaaacataaccggaatttgttgtcttcaaatgaaggctgaatttcacctacctgcaaatgtaaaaaatgaatgaagaacataatgagtgtctgaatatacaataaaattgcctggaatcccaggtttttttaaaaaacagtttccactgaatctgtcaaaaacacttaaaaaccctatagttacaatataggtaggaatagtagacggaaggaaaactaaattattctacaaaatcaattcaagaaatagtgactaaaaacagagattttgccaagaattcaaaggaaactcaaaacaattataaaagtaactatcctcaaaatcgctgggtagatggggccaggaactcatgggaactctctatattcacattttataaacagtcatgtccccatcttcattctgcacagcttaacgttatacacattatgagagctcagggaacagccagcttcacacattatgattcaggtactgcacatgatccttgcatgcttgccatctaataacctctcatgcatctagaaatgatcctgaatacacacgtacacacatgcacacacacacacacacaccccacatacgcacagttcagtgactgctgcaattacagaggcttacttaaaattacctaagaagaagataacagaaaggatgagaagagcatcagagctttaggagaactgggatgtggggattgtgctacttcactcactagagatgtatgcacaataaattttaagactaggctttgctactctgtgtgacaaaagagtcaattattgaaattcactggacacattcctgcctctccaccactgcctgccccgctccacacacatgcaaacatattgatatgaaattagtagagtgaaaggaactattttagaggtaatatagaaatggccaatcatctgtccaggatggttttacaaagggttataaatagaggagggctgaaaatgcaaatcctaagagtctgagtatctgttctctttaattatagtaactaatattaattaggaaattactgtctgacattgttctaagcaatttatacattaaatgtatttaatcctcaaaataaccctatgagaaagaaactattatccacatcccactttacaagcaagaaaattgaggcacaaagaggttaagtaaattaaccatggttacatcgtcactaagtagcatcctcattgaataggaccaaatcatagtcaaatattctactttggaatttacaaatgtcctgacttgttttcttaaataagctcctgttaagtcacatcaattgggaccaatgtgtttgaattaaactttttaaaataaacttgacatacttggagtcaattttcaaataattgttatataagcaaataaaaaaattaaactaggattctaggcatagaatttagctgttttgtggtgagtcagatattgctttgagatccttcagagtttcaagctcataattctaaattccactataggataatcccctgatgaagtaaataagaacaagatgggctaaatctgtcccattttttacatttgtattttattttattttaagttctgggacacttgtaggatgtgcaggtttgttacatagataaacatgtgacatggtggtttgccgcacctgtcaacccatcacgtaggtattaagcgccagatccattagctatttatcctgatgtctccgccatcccccaaccctgtgtgtgttgttcccttccctgtgtccatgtattctcattgttcagctaaatctgttttaagaccaatactgatagtcacattttaagctatcataatataattatcccacatactagcttctgaccctaaataagacacttaccttctgtagacatgatctgtaaaatatgaaaacaaaattacacaagatctcttcaaattctaaaattctgtgatgcaatgactaatcccacaacatgccacatcaggatatacaaaattcatggtattttaaaatatgaagttgtttcaattttggaagaatgatagttgcttccaagacatagctacttttccattatgaattagggacaaaagcaaataatgtaatttgatgaggacatactgtttaatgcacaagaatgtctatgttacacaataatattcagcataccaatgtgctaatttctgaaactttattaaccgaaactttcttcaaatgtagctgacaatacaaaacacattttgagctaatggactgtcagttgcaaacattattatctggttatcactcatcagttgcatacaaatccctttattggaaacttatcatcctctcgaaatatgcaaattttcaaaatgcttacaaaactcacctttagattacttttaaagaagaatgttcattcaacaaaaatcaaaataaaactgattttctttttttggccagcatataggagttcagaagtcactactgcattctaaaaacaaatagaaagctgaataaattaaaaatcaacagctcttcttaggtccatgagagaattgaggtcttgagacaaatggacaccccccaaaaactggagagacagataagcagacacagaaatccaattccctggagcagaaatctctgctggaactagtactgggattgaaatctaaagctgtaatttatgaattgctggagactcagtttggacaagtttgagaattaaaatctcccagtggggccttcctaggaggtccccacacttttcggagttctaccttcaggagccctaccaggttctcacagagaagatcagagaaaaatcgcctatagcttccaatgtgtgagtgggtggagagtgagagagcagctctttcgaaaaacaccagagctttctgttctcagcaagacctaccctcaagggaaaatattctgccagtgcctacccaacctcgaagaagggaaaggctcaatttcagcccactctagccttcctgtttcacctaagcagggaaggtacctgcaaagttacagcccaagggcacaggctcagtaaaaaactgagtcctaattacaggacaggacaggacagtgctgcccctcacccaaccttaccaccacagcaatagggctcttgtatattaacaggggagcacaactgaaaatgttcacgtctcaggccttacttaagaaatttctagggaaccagatgttgccaatctggttaaagtctttggccctacaatagtagcccatgctgtgcaccatccggacccagtgacaatgttacaggacatcaagcatcaacccaaggtgatcgagcacctgctttctttgcccctggagtattggagtcagttcatgatggtggaacaagagaacattgacctcctatatgtcattgaaaactcaaatgccttttcaacaccacagacaccagaagtaaaagtgagtttactgggtcctgtggccactcctgaacatcagcttcttaagactccttcatctagctccctgttgctgagagaccactccaccctcaccaagaacactcccaagtgggagcaaaagcaagcctgccaccaacctaggacaataaggcaaccttttttgcttctccaatgcgcaagtgaagtcacagctgcctatcacttcccagcagtgactgactataagaaaggacatccctgtactctctgctctgcagcctcctgtactcattactactttggtttctagggaaacatgaagacaactgaggtgatagaaacacggacacctgaggatattttagcctatggcacctacagcaaaggaaactagtaaacacggcctaattcctagccagacagaccaaaaaaacccacactaaagacctatttacctcatttatttttacccagtgtctaatgtcctactttcaacaaaaattgaaaggcatactaaaagataaacaaaatttaagagacagggcaagcatcagaatcagactcagatatggttgagattttagaattatcagattatgaatttaaaacaactatgattaataaggactctaatggataaagcagatagcatgtaagaacagatgggtaatgtaagcagaaatacagaaactaagaaaaaaatctaaagagtgctagaaatcaaaaacagtgacagaaatgaagtctacctttgataagctcatcaatagattgaatagaggcaagcaaaaactcagtaagcttgaaaaaaaagtcaatggaaacatcaaaaaagaaatgtaaaaagaagaaaatgaatgaaatagagtatcaaagaaacgtgggacaattacaaaagttgtaacatatttataatgagaattcaagaaggagggagagaaaagaacagaaaaaaatacttgaagcaataatgactgagaatttcccaaaactaataacagacaccaaacctccaatctaagaatctcggagaacaccaagtaggataaatacaaaacaaaataaaaaatgaaatctaggcaaaccatattcaaaaacacagagaaaatcttgaaagaagccgggttggggtggagagtgggtgagcctacccagagagaagtaaaaataatgatatcagacttctctctacaaccatgcaagcaaaatagataatgtagtaaatatttaaactgttaaaaggaaaaacccacccacctagaaaaaattgtttttcaaaagtgaagtctttatcaggaaaaatgaaaattgaggatgtttgtgctggtagacgcttctttaaaagaggttcttcagaaagaaggaaaatgatatagatcagaaacctggatctacatagagaaatgaagagctttaaaaaaggaataaataagggtaaaatgatatcttttatttttcttacttttaattgacatagcagatagcagctggttcaaaataataacaacaatgtattcgatgattttatctcatggatgaatgaaatgactgacaccaatgttataagagataagagggaggaatttggaataatcagttacaagggacttgtcctatctgtggtaatatagtattgccaagtggtagagtgtcttctgaaaataaactgaaattaattgaaaatatatatttaaactcaatggcaaccactcagaaaaagttttaaaaatataattgatatggtaagagagaagaaaaaaaaatcacattaaatgctcaattaaaaccagaaaagacagaaaaacagtagaagacaaaaaaaagagagagagagaaagaaacaaagagcaggggcaacaagtagaaaacaatagcacagtaacaaacatgatagataatgatctaactatatcaataatcactttaaatgccaatggtataaatacactcaaaaaaaaagagagagactaagtgcataaaactacaccaaactctatgttgtccaaaaacaaacaaacaacaacaacaacaacaacaacaaaacccacccagctatagagacaaatagataaaagtaaatgaatgaagaaagaaataccattactatactatattagttcgcaggggctatcataacaaagtaccacattgactgggtggcttaaacaacagaaatttattttcccacaattctggaagttcaagatcaaagtgccagcagggttggtttgttctgagttctttctccttggcttgaagatggccactttcttctctttgtatcgttacatgatcttgcctctgtgtgtgcctgtgtcctaatttcctattttataaagacaacagtcatattggattagggccaccctaatgacctcattttaccttaattacatccttaaagaccctctctccaaatacagacacattctgaatttggggcacacaattcagtccattacattgttaacacaaatcaaaagcaggttgcagtagctatattagtttcagacagtacagacatcagagcaaggaaggttatcacggataaagagaggcactacataatgataaaggagtcaattctcaagaaaacaaaacaatccttaataagcatgtacttaacaatagattagcaatatacctgaggcaaaaactcaaagaactgcaaggataaacagatgaatccactattacagttgcagacttaaacactgctcaatctgcaattgaaagttatagagcaggcagaaaagcagtgaagaaaacagcacaatcaattgaatctaattgacgtttatggactacttcatctaacaacagcagactacccattcttctcaatctcacgcagaacattcaccaagatagaccacatttcgtgtcctaaaacacatcttaataaatttaaaagaatagaaagcaaacaaagtatgctctcagaccacaatggatagaaactagaaatcaaggacagaaagctataaatcgtaaagacagaccattggtacttagacaaaaatttacataattgaatgcatatattagaaaaaaagaaagatagaaaattcaatcatttaagcttctacccaagaaaactagaaaaaaaagagcaaactaactctaaagtaagcagcagaaaaaaataatattaattaaagtagaatacaagacattgaaaacaggaaatcaaaggagaaaaatcaatgaaaccatagaatggttctttcaaaagatcaataaaacggatacacctctagttaggttaactaaggaaaaaagagaaaagaaacaaatcagaatatcagaaatgaaagagggactatttctctctttttttttttttttccaagacagagtttcaccctgtctcccaggctggagcacagtggtgcaatcttggctcactgcaacctctgcctcccaggttcaagagattctccttcctcagcctccctagtagctgggattacaggcatgtggtaccactcccagctaatttttgtattgttagtagagacggggtttcaccatgttggccaggctggtctcgaactcctgaccttgtgatctgcccacctcagcctcccaaagtgctgggattacaggcgtgagccaccacgcctggccaagagggtctatttctgttgaatccatagacatttaaaagctaacaagggaatattacaaacaactctatgcccacaaatttgataaccaaaatgaaatggaacaattccttaagatacaatccaccaaaacttacacatagaaaaactaatagtctaagtagacctttgcaatgaaatgaacatttttgtgcccttaaaatttatattttcaggcttgttgcagtggcttatgcctgtaatcccagcacttttggaggcagaggtgggaggattgcttaaactcaggagttcaagcctggaaaatatggtgaagttctgtctctactaaaaatacaaaaattagccaggcatggtggcatgtgcctgtagtcagagctactcaggaggctgaggtgagagaatctcttgagcccatgaggtgaaggttgcagtgagctgagatggagcttctgcatttcagcctggggccacagagcaagattctgtctcaaataataacaataataatataatatatatatatttcaaaatattatatatatatattcagagcctaatcccagtatgatggtctttggaggtgtggaggtggggcctttgggaacagttagattatgaaggtggagttctcatgaatggaattagtgcccttataacaagaggtcagagagctaggcagctctctttctgcaatgtgaggacaagcaagaagaccaccctctctaaatgaagaagaggacactcaccaagaaccaaaccatgctggcatcctgatttaggatatttaacctccaaaacaccaagaaatgaatgcttgttgtttaagtcattcagtctgtggtaatttgtgtagtagcctgaactgattatgatatcttatatctataaaagaaattaaatcaataataaataaccttccaaaacagaaagcagcaaatgaagatgggtctactattgaattctaccaaatatttaagaaagaaaccaattctttaaaatctcttacagaaaataggagtggagggaatatttcctaatttattttacaagtccagtattaccttaataccagaaccatacaaagacaacacaagagaaaactacaacaaatatcaaacctagatacaaaaatcctcaataaaatattagcaaatcaaatccaacaatgtataaaaagaattatatatcatgaccaaaagtgatttattagtgtatgaaaatctagttaaatattcaaaaatcaattaatgtaatccatcacatcacaaagccaaagaataaaaatcacgattatgacaacagatgcagaataaacatttgacaacccattaatgataaaaactttcagcaaactagggatcgaggtgaactttctcaacttggtaaagaatagctaagaaaaatctacacttaatatcacacttaatgacaattaactagaagctttcctgctatggtgaggaggatgtccttgctcatcactcgttttcaatattgtaatggaaattccagctaaagcaataagacaagaaaaggaaataaaaggtattaatattaggaaggaagaagtaaaacttcatttgcagatggcataattgtctacatgggaaatctcaaagaatcaacaaattactaaattaataaaatattattttcagtctgcaggataccaggttaatatataatagtcaatcactttcttatatgccagcaatgagcatttggaatttgaaataaaaaacaaaatgtcatttacattaccattagagaaatgaaatacctaggtataaatctaacaaaatatacacaagaactatatgaaaaactacaacattctgattaatgaagtcagacaagatctacataaatggaggtaccccatgtacatggatagaaagagtcaatattgtcaagatgtcagttcttcccaattagatctatagttgcaatgtaatcccaatctaaatctcagccaattattttcaagttatcaataaattgattctaaattttatatggaaagaaacagaaaaaatacaacatcaacagcacgatgttgaaggagaagaacaaagttggaggactgatatcacctgactttaagacttaccacaaagttatagcaatcaaaacagcgtaatactggcaaaagaatagacaaataaatcaatggaacggaatcgagagcgtagtaatagaactacacaaacacagtcaattgatctttggcaaaggagcaaaagcaactcaatgaaaaaaaaaacagccttttaaaccaaagatgctggaacaagtagacatccataggcaaaaaaagaacgaatacagaaggagttattatagctttcacagaaataaacacaaaggacatcatagacctaaatgtaaaccacaaaactgtaaatatcttaggggatgacataggagaaaaatgtaagtgattttaggtttagtgatgaatttttagacagattaccaaacatatgactcatgaaagaaaatattgataagatggacttcattaaaattaatcattgctgcttggcaaaagatgctgtaaagagaattaaaagacaggccaccagctgggagaaaaatctttgcaaaacacatatttgattaatgactggcatccaaaatatatcaagatttcttaaatatctacagtaatagaacagataacccaattaaaaaacggacaataaatctgacctaacatctcaccaaagatgacatagagattatagattatcatatgaaaaaatactccacatcatatgtcatttaaacaactgaaggataaaagaataagatacgtttacacacttgtgagaatggcaaaaatccaaaacactgacaatatcagatgctggcaaggatgtagagaaataggagttctcattcattgatgggctggtagagatgcaaaatggtacagccattttagaaaacagtttggcagtattttataaaactaaaaatacatttggcatatgattctaggtatttacctacatgaattaaaaactttagactacacaaaatttatggatatttatggcagtttcattcataattgcaaataacttggaaacaaccaatatatccttcactaggcgaatagataaattgtagcacttccatgcaatgtaatgttttacaacaataaaaagtaatgagctatcaagccatgaaaagataaggaatcttaaatacatattattaggtaaaagaagctaattgaaaaggctatgtactatatgactgcaactatatgacattttggaaaagacaaaatgtctatagagacaataaagtgatcagtggtggcagaggtctagtacaaggagggagagaaggcagagcacaggggattcttagggcagtgagactattctgtacaatactctaatagtagataggtatcatcatacatttgtcaaaactcaaagaatgtgcaacacgattgattgaccccaaatgtaaactatggacattaatagtaatatatcaggtcaggcaaggtggctcatgcctgtaatcccagcactttgggaagctgaagcgagaagatcatttgaggtcaggagttcgaagccagcctggccaacatggtgaaagcccctctctactgaaaaaaagaaaaaattatctgggcgtggtggtgggcacttgtaatcccagctacttgggaggctgaggcaggagaatctcttgaacccgggaggcaaaggttgtagtgagcagagatcatgccactgcactccagccagggcaacaaagcaaaactctgctcaaataataagaataataacaacaacaatatatcaacattgactgatcagttacaacaaatgtatcgcaacagggcaaaatattagtaataccggaaagtgtgtgtggagggatgtagggtaaatagaactctatgtactttcaactcaattttctattaatctaaaatggctctaaaaataatgtctattaattttttaaaacccaccaaaaggcatacaatcatcttttgaaaatgagtaattattaagcacaaaaataaagcaatttaactacttttactttcaggaccaattcagcaattactttcagatattattgttccttaaaacacaatgacgccgaaatattccactgtgtccttcctttctcctttctaaaaacatttttcatcaaagaaaacttctcctactgaaaaatatttggcaaattatctggaaataaaactattttgcccttgcactttgccacctctcaataaacaagtttgttttcaccggaaatctgattttttggcttttaaacagaaacacaccagacttgtgctttgtaacagagaaggaaactgagggttgaaggtcagactctcattgcagcaaacacatgaacccctcacagcagccaaatgccctacagttttcagagacacagtaaagtgaacttccatggaaaagaacaaaattcaaaaagcaggggaaatgaaaaaaaagttactggtaaacaataacaatagactttgtaatacgtttggtttgttcgtgtgtgtgtgttataacatatgtatttactgacaaacgtttataaaatagagggctacaaggaatacacagaaagagttggacagagttcttgctgtctttggaagacaaattctttctaagcttatttctttcctcattcaaattagatttaaagggtcatatgcagggttgtgaagcttaacacagtcacgagtgaaaaaaggaaaagggagaagggaattgaagcaagctgtatcttcgaagccacaacaaacttcttatgttgaaataaaaggtcacattaaaaggaaggaattgcaactaaaagaaaagcaagattttatttttctttgtcaccgcttctactaaattactaagctgtcagaagaagaaatcttccgattgttagatccactgctcttaccaagtgtaggcatcactcgataccgacagacccttttttttcccaactgaagaacacagggtgcggtacagagatggacgccagagcctgtgcttgagcagcgcagagcgctcctggggaattcagtgaaagttgcaaatacaatacagcctcagttaggaaagtaaaggatacagaccccagaaaaggtgcaattccctgacaaagtctgtttgtctgcagcatcaaccaccttcaaacattttttattaactctattttaaaatacagaacatatttagattttctagagccctaatatcttagtggtttggattaaaactgtaggctgcaaggttaactctgctgctgctgcgctcctgggaaacctgtcattagtgttctctttatcttccgtgaaaaaaaaaaaaaaaaattctgaaaaggacccggtacctgcctttaggttactatgcatcaaaaccaacataaagcatattttctgatcatatttattttcacagctgcaatcaaacgaggaagtaaagtaggtgcttaatataccaaaaatattgcgtgcacgtaattttctttaaaaacctcattcatctttttcacgtaaaaattagaaccaaacacattcaacagaatgacatccagcaactcctctccctaaattagccccctccctctcctttatatctctctccaactctactatattaccctatttggaagcgggcggcatcaggggagccaactgagctatcaagaaaaccaaaccaaaggaaagaaggaggtgtgcagtgaatagagagatggtagaagaaacagtggttttgaagtttctgctggagctgtctttctgtattataggttttgaaataaagtgtttcatattttttttccagaaaaatgaaagtacgatagagatgttgaaatcatcaataaggaatggctacagtctgcataatttctagctgtttggttttagaaagagaaaccagtagagataaaaatcacaccttgtgaaagtcagtgatgggatctcttgcttttgggagggtggaaacagttatttccttggcctgacacacgctgtcttactgctggggcatgcagctgagtacattgttctccgcggttgtctacttgaaaagtatttccagtcagaagagagtcacgtgcagtgtctttgacctaaattctccatggtgctactattcattcttcccttcccttcacattatgattctttgcatatactttattattcatcagttcactcaaagaacccccgtgtagctctaaaatttatttaaaaaagaaaatttgtgtcaaagtcagctactaaaagcaatagaagatttttttaaaaaaatttgtgatgtatatacatttaagaagaatacaatattccagtgtatctatataaaaatccaaattatttattttgctcaaaagattttgtttacattaaaatgcaaaatcacggatgattgttaaattcatgccagtaattatttctaaagagacttatagataaaaacaacaaaacaatcctgaacacggtattttaaaactgatcttaaatgcaagcgttttcacttgcagacttgctctgcctttgatcaaccatactaccttggacaagccaattcacttgtcttggcctcaggctccacactataaaataagatgtttaagaataaaatctgaaatggtaatttacggtgctaggatcttcatatgtatagcctattatttaaaatttagagaacattctttgttaacacagagaaaaataaaatataaaatatcacattacctttgttttgggcttgtttctttgcatatgtgaatacctctgcttgatgcatgctttttagtggttcgaaacactcctttccattgttatgcaaagtttcctttcttgattatgaagggaaaattagttactgtcttttctatgctgtgacaatgtatatctctactcatatttctcatgagcagttatatctattatctttctatactattaaactcagatccatggggcagtcaatagtgctgagcataaactgagtgctcactaagtgttggtggaaatgaatggatgatcacatgacgatcatctatgtccattgataatctcacaatgctatgtcaatgaaaacaaagtgtgtccataacagtgaacacccacctgaaaagagatgatttatggcaaatcataaaccagaagtttaaagaaatagacatgaaaaggtccagaggatttaactttatagatgcaacatcttctaaagtcaaagattagataatatcgtgaatattgagccttggggcattcagtgtctactctaggtcttcaaaccaaaagcagtccacgtcaacagagtttacacaatgaggaaaagtttattcttaaaaacaagcatgacccaagaaattatttagctttttatctaatcccaaaatgaacttcacaaagctttagaacacggttttgctgtttaacatattgttgttttcagtaaggtccaccttatgaaagctgtgactcctttgaggtggtcaaattaaaattttgcagaaagcttacaaattatcacatgcaaagtgaggtacttaaaagggtcaactacataattaacttcacttccaactcagtcatacatgctaatgagatcttgggacaggatgaataaatgcaattttcagttaatcccaaaccacatcatgactatcaattgcaattttaaaaattactaagcattcttcaaaaacactgttctgaaagaatattagaaagatctgactcagctcccctggctagcctctcagtggaggtgctaatgagcagtgaaatggctaagaagggtctagaaagataaaatagcaaatgttttccaacctattcacccagactctcattactctggtacacatctgcgccaccgccgcttgtcttatccgcttttaataaattatcatatgatgctttatgctgacttttttttcaccagcttttattgcttcacagtttttaactcatcatttttggtttaataataatttgtattattaaaacagcctggcctggcacagtggctcatgcctataatcccagcattttgggaggccgaggcaggtagatcacctgaggtcagcagtttgagaccagcctggtcaacacagtgaaaccccatctctactaaaaatacagaaaacagctgggcgtggtggcgcacacctgtaatcccagctacttgggaagctaaggcagaattgcttgaacctgtgaagtggaggttgcaatgagctgagatcatgctactgcactccagcctgggagacagagtgagactttgtctctaaataaataaataaataaataaaaataaaaataaacagcctgtatggtagatcctttgttctgttttgtccctttcagatccaccctgaaaaaagcttcctaaatgccttgtttgtttgtttgtttgatcgattgtttgttttgagacagggtctaactctgtcacccaggctagaggacagttgccccatgtcagttcactgcagcctccacctcccgggttcaagcgattctccagcctcagcctcctgagtagctgggattacaggcgtgagccaccatgcccagccctaaatgacacttaaagggcaatgtgactatgtcaactgtctgtttaaaatcaacagctccaagctgctaggataaaatcaaaactattcaacatgaccacaaggccatgtacataagaatcctatttatgtcttccagacacctctcctggtacctttcctttattttattttatttttgagacaggatctcaccctgtgcctcaggctggagtgcagtagcacagtctcggctcacggcagcctcaacattccaaggtcaagctatcctccagcctcagcctcctgagtagctgggactacaggcacatgccaccatgcccagctaattttggtattttttgtagagacaggggtctccctatattgcccaggctggtctcaaactcctgggctcaagtgatctgcctgcctcagcctcccaaactgctgggattacaggcatgagccaccgcacctggcctatacatcagccaatctgaactactttcaattccctcaagtccataatctcctacctctccactttcagccttcacacatgcctctctaatacaacaagctagtgcctgcctgcattctctgctcatctgtgccatacatgattaggggacaggctctgagcagcagcctctcttgcactttgcctgtatacaggtaaatctgtccaactccaagctgaagcattaataagcccccttggaaagactaactaaagttcttttcttcaaaactcctcatcagtaaaagcagctaacatttttagctccatctgccagagtgtttgtctacaatccaaacttgggtgagtaacaagatttattgggtcatgtggaataccaatacctgagttgcagttgtctacttgcctttcttccccattagcctgtaaacatctgtgatataactaaccatgtttaccttgatcatgattatattttcagcatctaacagtttatctggaacatagtaggtatatgatggtcattcaatcaaaatttatttagcgagtaaatgaatgggcacaaaacaaccaaaaaatccagacttctcagcattgcactaatgcctctagaattgcatttctcaccagttcctaactaatttttagaaatatttaaacacttacaccttattctaaaacattattagttcttattgcactgatttagtattagataacttaatctatcataggtttaaatgtatctttgttcaacagaaaagatttattaatcaaagataaagtactgtaaatgtaatcatagaatcttcagtgtgaaaattagtttattagttatctatcaagaaaaagcacccaaaaataacactaaattaatttctctgtaaaaggtgctgaggtcattttaaatgattttcatctgcttataccgttaaaaagataagatttttctttccaaaaccatagtaatagtggctttcaaggcttttggtatgctaggaataaaaaaaaactatgctatttgtgtttgaaaattcagtgatttagactgtcttctaatttggccttgtgttatccagttttaataagtcacctaccatgcttcacactgatgtttttaccaggttttattacttcacaatttttaacacatttgtggcttaaatatgtcgtctttttttttttttttttcttgagacggagtcttcctgtgtcgcccaggctggagtgcagctgcaagctgcactcggctcactgcaagctccgcctcccaagttcacgccattctcctgtctcagcctcccaagtagctgggctgcaggcgcctgccaccacgcctggctaatttttttttttgtatttttagtagagacgggatttcaccatgttagccacgatggtctcgatctcctgaccctgtgatcctcccgcctcggcctcccaaagtgctgggattacaggcgtgagccaccacgcccagccaatatgttgtctttcaaaccccttttttattattaaaactgtcctttttccttaccacaggcaatagctaaataaacataatattatagtgtaacaatgtggttcagaaccaacggtagggaccatgcatactcattaagtgaaggtctacaacaaagagggcaaagtgccaccaaggcttgactctgtggaaatgggtacacagatgaacggtccactaatagaaagctccattggccaggccctgccttgtgtcagggactaaggcagtcccgtggagctctctgcttctgaccatcattgtaacggtacaagtgaggtagaaccacccacacagagaaatgacagcagagaactcaagtaaaacacacaaattgcataacaagtaagtagaatgcctagatttaagcataaaaggacagaattgaataaatcaagaaaaataaaacaaatagacaaccctgcattccataatggtgttggatataagaagtataggtgaatttgcataattaagctattggaaactatccagatctttaaaattatataaatgttctacaagctaatatgttaataaactcattcaaataaggtcaaaacattgtattcttaaataaataattaataggcaaatcaaagaaatagaagagtgtgaacaactggtctccaaaagacaacatatctgagacaagaattcatcaaagttagactttggaatatgacatgactgtaaagtagccagactgattttttatgtcctaataatggaaattcctatcacaaattgaaaatcagtgttcacacctttagtattcctacaatggataaaacagtcatgtacgcccaaagtttagctgtattttatttagtactttcttgtcagcatgctgacaaatactacaaaaaatgaacaacttttctttcaatgttttgtcttttagggaaaataaaactcttcttgctctaataatatcttgaaatatgggttttaatttacataagctcttcatacctgttagaaaagcctagatattcctagtgaatggaaacatactatattcttcctaatatctaaaaatagtaatacattatttgatacatatcttaaatcaaattcttaccaaaaatgccttgtgattacaaacttgtattcatacaaaataatatttatataaaaagttaaagacaatcttaataattctcttcttccttcccatatcattagccttacagtgaggctattaacttcacattatcaggaaaagtgtataaaactatattcaatgtctacgtgatgcagtaacattatgcttaaattcaagtagagattcctggttcttcttaagaggtgatagtttataatcaaatggcagaaagaaagtgtgactcccaactgaactctttttaaccttcttgaattcctaaacacttctgctcagtagtctcccttcgcatgcgcaccacttaaccctccaaatactatgtggtcctacttcaatgctgtcaggttcaaaggtttctccaaattttccaaacatttaaaagtaaatatgtattgttacttttttcaagatgctaaacaaagttttaagaaataataccatttttgatgtgctattgtattagcctgttttcaccctgctataaagatactacccaagactgggtaatttataaaagaaataggtttaattgactcacagttccacatggctggggaagcttcaggaaacttacaatcatggcagaaggtgaaagggaagcaggcaccttcttcacgaggaggcaggagagagaagtaatagaagggagacttccaaacacttataaaactatcagatctcgtgagaactcactaactatcatgagaacagcatggggaaaaccaattgcctgatcaaacacctcccttcctcgacaggtggggcttacaaaatttgagatgagatttgggtggggacacagagccaaaccatataagctatcatttagtattttcttttagagtacccaaaaaaagatcagtcccttcccctcttgcctccacataccttcttcccactcaggccagactgtgacttaagagagaaataaatcacttgtgtgagccactgagatgtactattattattttttacaatgagtcaatgctgaaaaaacaaataatatggcaataaacaaccatagtgtctaattcaagtactttcaaccagatattcaggcttagctgcatattggattcaagtactataggtttttcaaaaaataccaatatctgagttttaatctgaatcaactgaaactctatctcaataggtaagccaaatagccctagtttttaaaagctctctaagtgagtctgatgcattagtgagagttaagaaccgctgctaatcgtggagctgcattaactcaatcatagtaaaggtggtatctttgcagtgttgtatctattttatcaaagcccatgtaaagcctaaaactgtccatttaaagcaaaaaaaaaaaaaatccaaattgaattctggaaaccttgctttaaaattccaataaatatttcacaattgctccatttattcctcaacttcaggcaaatgctagctttcccttaattaaaataaatatctggtcagaatagaagctcgtttttaccaagaaacaactgccacaacaatgtaaagactgactacagtttcatgaggtgtaagtttaacaacactgaagactacttggattctatttcaattccataaactaacgacttgtttttcaagcaagcatcaatttatattactgaatatttaatcaccatactgcctgaaaggttatttaaacacaacttttccaggtggtataggatgagcaaaaactgtcacatcaactgagtcaattattccgttcttaagttcagcagcctattactaaagcagagtcaaaagtaaatatcaatcatactaaaattttatatgcatatgccaagtgttcccattgttcaattcccacctatgagtgagaacatgtggtgtttggttttttgtccttgcgatagtttgctgagaatgatggtttccagcttcatccgtgcaacaaacctgcatgttgtgcacatgtaccctaggacttaaagtataataaaaaaaatacatataaaaaaactttatatggagagctcctgagtttctgagatcaggcttatagacctggaaccatggcaaaagttcacaggaaaagacagggagaagaaaatgaattttcacttaggctatgatgctgaaaatatcaattacttattttccaaccacaaatttgtaattgatagctttattctatttaccactaagttaattaaaagtaaataataatagtaataactagcaacagtagtaatgctaagagagctatttgcttcttgttttgtgagttttacatctactcctctgcagtcaagtatactgatctggtttactattttgccctgactataattaagagtattatttcatccagtaatgaaatttataacagctaattttgaagatctgctaaggtctgggtactgtgtgagatagtttacatatcttcaatccatacaacaaaccttgaattaagtaatattatcattttacaaaagttaaaaaagcagcagtttggggggctcaggcaggtggattacttgagcccactagttggagaccagcctgggcaacatagcaagactctacaaaaactacagaaagaaatagctgggcgtggtggcatgcatctgcagtcccagcttctccagaggctgaagtgggaggatcgcttgagccacagggatggagattgcagtgagcccagatcgtgccactgcactccaccctgggcaacagagtgagaccctgtctcaaaaaaacaaaacaaaacaaaaaccttgaggcctcaccgtaagatcatttaaatttttaaagttgttttgaatgtactgacaacaggatttgaaccctagaagtatgactatttagcttgctttctgacacgggccttattattagttttcatatgtgtaagatcaatgcctactaactggaatattctagtaaatttgtgaatgttcttcctaaataaactggggttcttaaaatgaggattgaattagtttgatggattataataatatttgtttccaaattctgctgggtagaatcaagacaggtttttgaaagtatgtttctcaaatttgaaaaaatgtatgaaatatttatcttggcaataataatagtgatgtgacgactgaaaagatttatgtacaggtcacttctcaagagttaggaatcctaaggcttcctctcaatcagtacaccagctcagcaggcgtagggtttgatgtttgtttgttagcatattttgccatttaagatgcattcaatttttaatataaaataagtgaaacatattatctcatgcataatcgttggctaaattgaatgattttaatcaaaagtagcttacagaaattatcacttcgactatgtctaacacttaaagattttgtacattgtatgaaactgaaggaaatgaagggaataaaagaaagattacaaatacaggattttacggtttgaagcaggaatagggaaagtgttatctagaggtaattattgttaatcttttaaaaactggggaaatagtttttattttatttttatttggtggaaaaaagcataaaaataatataattaacaaaaatgacctaccactcaaaatcaaccaagggcaaagtttagttatatcagatttcatctggcttttaaagggatataacttgttgcacagaaaactcatcctttttagaataaaattctaaaaatcttggaaaatgtatgcagtcacataaacatcattgtaattgagagatagaacaatttttcataaattgtcttgtccatctgtagtcaaccacttgcctcacttccaaccactcttaagcactgctttgttttttatcttgattgccttttgagagtgtcacataaattgattgattgcctttagagtctggcttctttcactgagcatgcatttaagattcatccatgtcctatgttattgagagtttcttcattctttactgctgagtagaattccatctatggctgcaccagagttcgcccattcagcagctgaaggtcacagattattcccaatttttaatgacaacagataaaaccattataaacctgcgcttaacagatttttgagtcaacatacatttttatttatctcgggtaaatacataagggagggcttgctggaacattttaagtgtatttttgattttataaaaaacagccaagccatttttcaaagtggttgtaccatttagcagtcccacaacgatgtttgagaattccagctgtccactgtcaggacttggtattgtcaggtttttttggttttctttgcttggatttttgttctgttttccttttttaaaaaaaactattcccataggtgtattgtgttatctcattgtcagtttgatttgcatttctctactgactaataatattttatgtatttttatgactatttgccacctgtatatctttcttagtgaagtgtctatgtaagttgtttgccctctgttttcttgttagtgggtttttattattctttatatatttaggatatcagtctcttatcaggtatatgtttcgcaaatgatttcccccagtatacggtttgtcatttcatttccttaatgtgtcacaaaataagacacaaaataagtgtcttccattttgatggatatcaactttttctttcaaaacgagactttttgtgtttgtcctaggaaatatttgcttaacataaggtcaaaaagattttttcctttgctttctcttaaaagctttgtaagttaatgttttacagttatgttttatatccattttgagttaatgtctttataatgtacaagttaggtcaaagttcaaggttcatttctttatacatggtgtctaattcttccagtatcatttgtttaaaatactttgcttttctccacttaatactctatgtatctttgtcaaaaataagctgaaattgtgatgtgggtttatctctagagtttgttctctattccattaatgtatatatctatcctctcaccaatgccacacagttttgattatgatggctgtagaataagtcttaaaatgaattagcatgacttctccaattctgttcatttttaaaattgctttggctattctacttcctttgcctttccatatgaatttgagaatcaacctataaaacttcttggtggtatttttattgaggttgcactgaatctatagataggtttagagagaattgacaatttaatattgagtcctccaatcaattaatgtggtgtatctttctatttaggtctttgttttctttcatggctattttgtatttttctgcataaacggcatgtacatattgtgttcggtttatacctattttatatattttggtgctatttgtaaatggttttcattttttgtgggagtcatagaacataacgcaattttattttgtcaagtgacttttattgcaggctgcatccctggtatcaagttaaataataaatcaatatagcacaaggtgcctcaaagatggggaggggagaatttaaaggaccaaaacgaaggaggaaagctatgaggacagataatctataatcagattttaaaggacctccaactcttcaagtggctgtgattattgcataacgtatcagacagatacatagaatggaaagtggcttaacaaatattttaaacaatgccttaatttcatggtgataacgcagttgcactgtatttctcatgcttctttggagctctttatataccatgcagagctttctattttgaaggtcctgtctcagcagacaaaattccatctccctctgtgatttttaaaatgtcctttaacaggttaaggaagtttacttctattcctagttaaagaaatttatcgtgaatggatgctaaaactttgtctaatgctttttctatgtctattgtggtgattataaggtttttcttttttaatctgttcttatggtgaattacactaattaaatttcaaatgttaaaccatttgaaaccatttccttgctttcttagaataaagcccacttggcctatacatgttgcatattggtttcaatttgcttaaaatttccttgaggaagtttgcatctatgctcctgagatatattagtctagagtgttattttatttttgtctgcttttggcatcagggaatgctggcttcataaaatgggttgggaatgattttcgttattctttctttctggcaggttttgtgatagaactgctgctattatattttccttaaatggcgggtcagactccccagggaagcatctggagttttctttgttgcaagctttacaactattaactcagtttatttaatgcatataggaggactccagttacctattgtgctctctctgtctctctctctctctctctgtctctctctctgtcacacacacacacacactcacacacacctgattttctctagttaccagagatcagagcatttcttgatatatttattggacatccatgattacttattccatgaaattatattgttctattattgtttatttttatttatttatttatgtatttattgagacgaagtcttgctctgtcacccaagctagaaggcagtggcatgatctcagctcactgcaacctctgcctcccaggttcaagagattctcccgcctcagccttccgagtagctgggactacaggtgcgttccaccacgcccggctaatttttttgtatttttagtagagacgaggtttcaccgtgtcagccaggatggtcttgatctccggaccttgtgatctacccaccttggcctcccaaagtgctgggataacaggcatgagccaccgcgcccagccctctcctgttcttttatttgctcattttctattgtatcatttgtcttttttcttagtgatgtataagttatttatatattcttaacacttaaaaaaatccaacctgtttttcaatattttattgcttcatagaagtgctttacattttgatatggtaaaatttgtcagtattttttattactacttttcctctatatttttaaaatccttccctgccctagtgtaataaagatactttcctatatttttattgttttttacaattagatctttattaggtaactcttatcagatgcatctagaatttattttcatgtgtagggtaagatagggatatgtgtgaggcagtaaaataatttattcattgtctgcataaacctgttgtcccatcaccattttttgagtaggcctacattgattagtaattcctcccctattatatatcaaggacacagaaagctgaactatttttgacctatattgggttatagtcatctatgtatttatttagtgctaaaccacagttgtaattactgtagtttaagaataagtctagatatttagaaggcttaattctcccaccttctttttctttttcagaattatgtcaatttatagaacatctcttttccttacagaattttagaatcagtttgtagattccatgaaaacttttttgaaaatgttcttgaaattgcatttgaaaatatatgtatatctatatctatatatgtacacacacatatttgaaagagatgtgataatgagattgcatatctgctaaccagatctatcttatcatgtgttcacatttgctttctgccattaaaatctcatatatttttggtaaatttactgctgggattagtataaaactttttgctattgtaaattagattttaattacccttgttttggtattgttgagatactgaaatgctcttggtaatacatgttgacctatgccaagcattcctgctgatctcttattatttttaattcttgtagaatgtctttattatatagacaagtgcattgtcttgattaatgccaaatttgcctccatctttccaacctttccacttatatgttttcttttctgattgctctgattaggaaaacaaagtcagcgctgaatagcaatggcaagagtgagtgtccttttcctgtacttgacgttattgggaatgtttctagtgtttcaccattaaatataatgttacttacagtttttgcaggatttcccagatcagtttataaccattctattctattcctaatttacttataatttttatcataagttaatgttaaattttattaaatatgttttctttcatttatttataatttttttttctgagatggagtcttgctctgtcactaaggctggagtgcagtggtgcaatctcggctcactgcaacatccatctcccggttttaagtgattctcctgcctcagcctcccaagtagctgggattacaggcacgtgccaccatacccagctaatttttgtattcttagtagagatagggtttcaccatgttgaccaggctggtctcgaactcttgaccttgcgatctgcccccctcagcctcccaaagtgcagggtcccaaaggcatgagccactgcacctggcctacattttattaaatgcattttttatgtttactgagatgatcatatggtttttttccttcaaacattgaaaatgaaatttcagctctttaaccatccctccattccaataagtgttatttggaaagaattatttttaggacacttttaggccaggtgtgatgcctcatgcttgtaattccagcactgtgggaggtcaagatgagagaattgcttgaggccaaaagtttgagaccagcctgggcaacatagtgagaccctatcactataaaaaaaaattttaaataagttgggtgcagtggctgtgggtatagtcccagctactcaggaggctgaggcggaaggattgcttgagcccagaagagtctgcattctgcccaccaggctacagtgagctagtattgtgccactgccactccagcctgggcaacagagtgagactccacctctacaaacaagaaaaagagacttttaaatttttgcagtacttgacgtatttacctctattcttaaacaaaacctttcttatattttcctgttgtttataatctcccatgtatcatatttttcatctccattgctgctagaatgatcgttttaagtgaacaatttaagtatcttatttccccagcaaatagccaacagtgcatctacacacttactgctcaaaaggccaaccatctaacatgtcatgcaagagccccaccccctaattgagctcttgttgatcaatgcacatctctcacatttctatactccagtcaactgagctgcttacaattcattgaatacctcatgcttttttcatttcaatattttattcatactactcctctggctagaaggccttttccttgattcataagtcaggcaaatcatttcaaagttttatggattagctctagcctgtctctgaatcctttactgacattttaagaggaatttcaactactgtcttctgcccatatacaccatataaagttccacctcaacatctgttatgccatataattcctacggttttattattataccaagtaccatattttatctttctttagaaatgtgtagcactaagcattctgtctagcaaatagcaagtttaaaaattacttggtgaatgaattacacagatagacttagcaagctctgatttttaggaccatctctaagtgtcttttgaccaacacctggctcttaattctagcttcttcctaacaatatccataaaagctttaaatgatcagcttattcctaagaaaacacatgactacagtgtgtattggtttagaaaaataacctctcatttgattgaagtttgtcttaaattacaaatctaaagttctctttatgatagatttaaaaagaaattaagacttaaaacttagttaagacaaacttacttttgtactaaagtgtgtttgtgtgtgtgtgtgtgtgtgtgtgtgtgtttgtctttatattaattgaatactttctcctggtgactttgttaagctatttgacttattttccctcatttattcatctcaacaactccacgattatatattatttttattaggcctacaaataacataactaaacttagggataatagatcctttctccaatttagtggatctagaagttgagaacagatggttctaaatcaaaaattgccatgaaactgtcatgaatttgccaaggaagaatgttttgtttcaggttgcttagaaattaattaattgaatgatataaaattttatttcaaatgatgtataaagtaaaataatataaccttttttcacccattaacctgactgaaaaagtctaaactttataattccataacaccaaaagaggttttatgtaagcagaaattagaattatttgttagttgtgaaaagagaaaaaatccatttgtatttataaattatatagtagtagaatttaatacaaaacaagattatcttcccaaatctacctttatctagaaaaataaaacaaccatagctatctcctctctaaacaacattattgactacaaaatatcctgagtcattgttgaaaatgaactttttgtaaatatttgttgccactatagcccacttcaatgcacttctctttgttattgctggctatgtttagcttagtaacctaagcaatggcacccaacaacttggcaattaatcattttaaaattaaaagattaagtccactgaaagcctaattatgaaaactggacaaagaaagaaagacaggagtgcaaataatttcagcttacttgttcagaaatgaacattagacaagaatgcttaatcaactctatgaaattgttgtcctatgaaagaacatattcattttcactaggagatgaaactttttgtagtcatatattcaaagactaaagaaccttatttgagatgcccaaaagataataagtaggacttgttgctatgacttcaacaaccagcatgcagctaatcagcatccattgcagccactgaaaaggaactggctatttcagtccttagctttacttctaaagatgcagtgatcaaaactgaaatttgacctagaagctgtcattggtctaaagatgcatgacaaaagatttggcaagtgctaataagaataggaaaacaacaaccaacaaagcagtcagatttctcaaactttcaggatggtaaagtgcatcaaaaccagccaagagcctaattggcaaagattatacccaatgtagcgtgaggggcaggctcattactctgatttgttgtcaatgttaaaagagtagatttttttcatactaaacagctaataaataaacagtgagatacagccattgggacagaagaagaaagccagggacaaagaaaacagaaggactcaacttgagcagagcaaacagctacttgtaccccaattctgtagtctttggaggaattggaagatcatattaaagctatgcctaccagtagagcaatacttcttatacacatttgcatctaaaaattcatctgcacatagcaccacatatcaattaaagaaggctttactgaaaaatgaaaagacataattacaaatatcctattagctttaaaaaaaattactattcagaatgctttgttttaattatgctgtattttattttaattatgttgttttgaatcagtccttgatgtaaaagataagagagaactgaatgagtctttcaacccaaggataatagcctctttaaacattcatcgtttgagctttaaaagccaagaaaaagcaagaaaggggaaaaatagggggcaaaagggaagacatggaagagagccccagaattatggagacctacagacaataatgtgaaatacaaggtattacaagaaagggatctttcttctttgcccttcatctcaattaagtcatacaagtattaaagtattaaaaatatgaaaataaattttaataatgctaaatcatgtgatctttttaaaaaaaagctgttggtatcctgcaattaccaacacttaactatacattttctgatagctaaagtttctaatttttaattttataacttagtttgatcagtgtaatagtccactatgttataatctatagttaaatatgttaaattatttcctttatagtgaatcagatctctttaggtctttgggtaaaattttataaatttctgattatatcatggcaataagtgggaaatagaatcttaaagccttgtctggaggttctgtttagttaaggagtgaaaccaactgaataatcataaatgtttctgtcatctataagagtcatcctcttgcatagcttccaacgaaggccatgtggcatagcaagaagtggtgtaacatctatctctctggacaagtagatcaacaaagcaatcctgaatcactgggttgacagaagtcataccagatcatcctcctacttaataacacgggttttgatatacacagttatttataattaattggaagttaccagaattgtgaatacttttcatttgtttgtgcttgttcttgatgactccttcctctcttcagaataccaacttctcctagtttgtattctaacaaataaaaagatgtttttccttcttattatcccacatattttcttcctttttattacatctgtaaccaaatctgcttggatctccatcactccctgtaggaaatgctgcaaagtcacaaaccatccagctgctcgtcaagatactcattcagaaagcttctcttgatgactgcagcctccatcgatgtcctccattcctgaccagtggttttaccaatgattatatttaatctagatctctgtgtcttacagatttttaaatagtttcctgtgtgcaagtttttatctccaatgaaagcataagtcctttagaatcagaaattatacttaccctgcatccttcgttacgtcattatgtgcagagcaagggtgggcatgggatagacccttcagtagacccctaagaaatacttgttcaatcgagtcaacactaaaataaatttaaaaggctgcttttgggggtgaagtagtttttttttttttttaaccagggaatggttggtggtcctacaaacaaaaattctcccacaacaatgatcttaagatgatataatgagatatgtgaattatcattggaatttttaaatatttgacatttcttgagttgagtatccctttacctgtcagctgatttaaaccaggatgtatttatcatatgatgtaaggggatttctcttaaggtaactgctgtgaaatgaatgaaattatttaataacactaatttttgtaggtatttctatgccttttttacctaaggaaccaactacttacaaatcgtatacttgtattaatagttgctctgcctttttcctctttagagaaatttgctttcttacatacaattaacaaataaaatttcattcttctttttaaatctttctttctttctttatctttctttcttttttttttttttgacgtaatttcgctcttgtagcccaggctggagtgcagtagcatgatctcactgcaacttctgcctcctgggttcaaacgattctcctgcctcagcctcccaagtagctgggattacaggtgcccgccaccactcccagctattttttttttttttttgtatgcttagtagaaacggagtttcaccatgttggccaggctggtctcgaactcctgacctcaagtgatccacccgcctcggcctcccaaagtacttggattacaggcatagccactgcgcctggcctaaatcttgctttagataggaaaaaaatatgtaaaacagtgacaaaatgtataacctagtcaaacatatatctcaagtacatctctatgaatatttatccttttatactatttagtaagaaaactgaaaaaaagaatgcagaaaattccctgagtatccagtgttgaagttcattatttgcacttcaaatctagatggaaatacatagttgacttacgttaataaaaactatctactaaatataatgtgtcttcaaaatattttgaaagcacaattccatttcagcacttttcttttatatatttatgtatttttcttaataaaataacaaacaaaaaatactatacccagaaggaataagcaaacactgagttatattttatcagatatgatctgttccatgccctgatatttctttaaaaaaaacacaatatatttgtttcggatgtatagactaggatttaaccatgatggtcatttttacctggagataacattgccaatggagcaaacatcatttctagaacttgtaaaatgattccttttaaatgaatcatttctaggacttgtaaaatgattccatcataacagccacacaaaacactatcttgcactcacatatataaaaacgaaacaaatcaatcaaaatgaaaaaaacaagaaccccctacacacaaacacacatgcacacacacacacacacacacacacacacacagagatgtaaatagcaatctaaaagtttagagttgttagcataaaacatataaacttacatgttaaaatttatcaactagttccctcactaattaataacatattaataatatataatgagttacaagtaatgtgcgtgtagcctaaggaagtctcagataattcctggtaatattgtatatttggtatttattttgtttccatttttttcttatcctcacttaataaagggaaaaaaatatctaaagacttgaagaaagaaaaatacccaaatctggttgaagccttaggtgtcttctctgtcagaaagtcagggttgaaaacacagaagaattactaacaaggaaagatctgtcagctttgagaaatgctgctatgggagcatcatcttcataatttggtgaggatgtggggctcaatacaattgattgattgactagtttataggcatctagagctgagtgaaatcttacaggaccaaggtagcacagatcaataatagctgagtttttggaataagaacaattatctcctgactcctagtgtagtgattatttaagcacaatatgcttcatctctgttgattcatttcacagtttgaatataggtcatgtatttatctatatattcctaaatacatgaaggtataaatagtctctataaataaaatacaagaaaaatgaacacaatacagttttcagaacagatgcattaacaccaacttcacgagacatactgtattatatcacaatttaaaacagtcaagaagcatatcttatcatttaaaaaactcaaatgccatcaaacattcttagacagtttgtttaacttttaaagttatatttaaataataaatgtatatcattagatcattttgtagtaacttgctgagggattctgctattccacggcattttcagtgtctgcctttctcttagatcattccccttctgaaatcatgaaacagttctttcctacccaacaaaaatctttgcttgaccttggacccgtccaaatttcctcccaccctccctcctttcctgtttccctcccctctctccctcccctctttcttccttacttttcttcctttcttttttttttttcctagtccttgtaatctggtctatgagagcagacttgtatcttcactcctttattaaaaatgctttgatttcaatatctgatataaatgaaaaaacccttaaaacaaaatatattgtattcctttctgttctttctgttgcactgaatactgtaggtcactcacttcttaaaactctttttttttctttgattcttctgaatgtgcactaactctgtctcatctacttttcagctgaaaagtccttcttgccttaatgttctagatccttcttgccttagtgtttctttcacaagggcctttggtctaaggttaactccctcccacaactgttttctataccctgttctgaacagatacactcattccacagttttgccttctttcctgtctcctgcaatgaccaatattaaatacattatactttttaaattttgtatttttgtatctttctgagttagcaaagtaggcagtcataggcaaatagcttgatgataagagtatttgttggtttctttgtcaattatctaaatgttgttgccttcaaagtctggacatgaccccaaataatgaaggaaacaatacacattcacaaataactataatgcaaggaggaagcagctgacataccagacacagagagacataaaagaaaggtagactttcatcagacgcagtatttactgaactccaggcatttgtgcaacttacttgtagctttaccagattttcctagcaacgtgtacaaatgtaataatatatgaaatatttattatgttcacattccttttccaatttcccttattttctacaaacatctttccaagatagagagaaaggagagttttgaacctattgaggctgaaggaccaaagggacagctaggtgaagacagctgacaggcatagatatgcatttgagagatacataaatacaaatgacactgaagctatgagacaggaggttattagtaactttcaggggaggggtttcagtgaactctggagaacatcacccaagaaggctgattagtgactgatgaaaaagaagagacagcaactatagaaacttagtaagtttagtagtgaaatgaaacagaaatgtaatagtaattccaagaggtagctcttggtaatattaggaccaggattagaaaataaaaatagtgcaggcatgccttagaggtatttggggttgcattctaaacaactgcaataaagccaacatcacaataaagcaagtcacatgaattttttgatttcccagtgcatataaaagttatgtttacactatgctaaattctataaagtgtgcaatagcattatgtctaaaaaaaacccaatgtatataccttaattttaaaatactttattgctagaaaaatgcttataataatctgagccttcagcaagtcataatctttttgctggtggagggccttgcctccctgttgacggctgctgactgatcagggtggtggttgctgaaggtggttgggcaatttcttacaataagataatgaattgcatttgtcttattttaaggcaatataattgctgcatcaactgactcttcctttcatgaaagatttctctgtagcatgtgatgctgttggttagcattttactcatagtagaactttcaaaattggagtaaatcctaccgctgctttatcaactaagtttatgtaatactctagaacctttgttgtcatttcaacaatatcactgcatctttaccagaagtaaattccattttaaggaaccactttcattattcatccatagaaagcaacttctcatccattcaagtttcatcatgacattgcagcaattcagtcacatcttcaggctccacttctaattctagttctcttgctatttctaccacatctgcagttacttcctccactgaaggcttgagcccctcaaggttatccatgaagactggaatcaatctattccaaactcctattaatactgatatttgatctcctcctatgaatcgtgaatgttcttaagggcatctagaatggtaaattctttccagaaggttttcaattgactttgtccagatccattagaggaatcactatgtatggcagctattgccttgtgagatatagttcttaaataataagacttggaagtggaaattgctgcttgatcctttcaatttgtaaaaaaaaaaaaaaaaaaaaaaagcacagtatctacgaagcacaatacagtgaagtgcaacaagacagggtacgcctgtatattagcgattagcgatacaagtgaaggaataacagctgtaatgagtggctaagtcagcttgaaagaaaggcattctggagtcagtttttctcgttgcatgccccagacttcctgcctcatcatcagtcggattacatgttaaaattgcaggtccagctctcaagcccaagccttctgaatctgagtcttgggagttgggacccaggaatcagtatttaatatatgctttaaggtattttagctaggcaataaaattagaggttctacaataagaaagtttatacaactagcaagagatatttattttgttattactgtatattatttaagcataccttatatatcttaaaataaatagcgaatatcttaaactgaaaaagaatttgttttatcatactgctttctagaattaacgcattattccattattctggttatgtcgttcatacaggtcaaggcttcatttctcattgggatgtggctttgtttgcttgctatagcatggatagtgagcattgagtacacagctttgcagtatttacccttgtctcctcacctcttgtcaaacagttgaaaatagaatgacctcaacttaaataagctgaaacacaataatgagctaatattttttaaggcctctaaaatttctaggttgaaactaactctgtcctggagtttcaacccatctcatttaccctaatttttctttgtttttcaaatgtctgggagaaaggcctcgattttttgtaatcacagagacagctctaactttgccagataaaagtattaataataaaaggagatttacatgaagagttttgttaagtggaaccttagttaaatacatctcttcaaaagaaaagtatggtgaaacccctagtgacactataccaattcaaattttgtactttgtaaagctaacacattcttgaaaaataaagcaagctcctaaacagttcactacaaagcatctagttgattgtgacaagaggatattgagcaaaggatttatgctaattgacctacattccagtttatgaccaactccactctaaataaaatgaacagtaccctacaatagccttagaaacttcagactcaagggaaaataaggaagattagctgattttatttgaaactattttgagtggagcttatcccagtattctaccaacacatttccacccaggcatgaatttccacactcaaatgttttgctgtgaaattttagtgtgactgtttagatttcttcatgtttctaattaaaaatttagtctttaatcatgtttttctcaggacttgtgctgagttttcagttgtaaacccaatgtgaagcacacttaacaagacagctcttttaggaattagatcaattagtcggctaccctcaatttctcctttcctcgtatgagctggctgctcctcacatcaaggaaaagcgatgtcctgggatttctgatgctagatcataagaatctttgcagcttctgcttgggttttttggaacattcattcttgggatgctgcctcttgaaacctagccaccattttgtggaaaacccaagccacttcaggacagcccgagataaactcgtagtcaacagctggcatcaactgccagctatatatatgtgagctctcttggacgaccagtccaatcctgtcttcagatggctgaatcccctgctgtcatcaggcttccaaggcaggagacttcaaatgaggattgctcagcagacagtcagccctcagaaccgtgaatgaaaataataaattgttgttttaatccactagtttgggagatcattttatgcagcaataaatgcttagaacatgacttttatcttcttccgctgaggttgggactcttatcagactttgtgattttctaaggaaaataacacactagaagccaaatgatcaaaagtattatccagtactctagcatcataaaagtgttcttgatttgcttaatggaaatagcttaatcttatcttctttacatgttttttttttctctaatagttactggatcaagagctgagctacataaatttatagaaccttgcccaaccttctcatcaaacaaatgaggaaacaggatcccagagatttataggacccattcaaaggcataagggattatcatctgcttctcctatttcaaaccttggctcttgtaccttgttcataactgtctcgagggtgtcatagttttcctgaaaaaaaaggtatgagctcaagacaatactgtgtgtcattattttttgtctaaatttgcaaacaattttacagatacttaaccaactccattgttactcaaattgagtaagagcaaaatatttccattggatatttttctcttgtcaaaatgtgtatactcttaaatctaatgtggaatgtttaagttgtcacatttcactgttcttatgttggggcatttagtacgtatcatgcagttggcatccttcttcaatcaaacaggatttatcctttccctccctgtccctcaaccagtactccttatactcacactttcaaatagataattcatttcatgggttttcctctcactaaaggttggtaaccctttcatctttgttttcctttttgttcctgtgttctgattaaattctcattatgtgttcctaacatactaaatatttgtgtttagatgtcttgctattacctctttttttttttcctttttgtttgagactgagtctctctctgttgtccaggctggagtgtagtggcatgatctcggctcactgcaacctctgcctcatgggttcaagcgattctcgtgcttcagcttcccgagtagctgggattacaggcgtgtgccaccacacccggctactgtttgtaattttagtagagacggtctcactatgttgctcaggttggtctcaaacacctggcttcaactgatccacccagctcgtcctgcctctcaaagtgctgagattacaggcgtgagccaccgcacccggccttgctatcacttcttaataacatttcaaatatgaaattaatttcttgtccaaaacatgcagaaagtaaaccattgggtttatcctttaaatattctatcaaggaacccactgcttccccagtcttcaagatttcaaatttctagacaaaatcttctattcattctcttattgctccatttcctaattttatagatttttcacttgacctatctctcatcaatcttttgctctccggttccactggcttagacatgtatcatattctattattatcatatcatatatatcatataatattattcccaaactggtttaggcatatatcatattatcccaggattactgtgacaactggatctgtcttctccaactaattctgttttaaacaacattttcactaatctcattatgtcttccctgctcaaaaaccttccatgacaccctacctcctatcattgcttttaaaagctctccaaaatcaaatcccatcctgtcaatccagctccatgtcttactgttccccaaacacacctccttactgccatgagaaggagctccttattctacctagaaccacttcctttccaaatgtttcacattcctccaagacaggttcagtaccactcccattaaacttttcataatatctgtcaaactaaatcatattcaacatcatttttaaacaaaacagtaatcaatggtctcatagtgatatacatgtagtctcatagtgatatacatgtagtcaagtagaacagtaagtgttgtgttcaggagaaaatgtaaaaatattcctgacctatctttccaatggggcctgaaattccacaattagagattcgcaggttaaagttcatcttaaagttaaaatgtaaatactcttagcaatgtgttagccctgcagtttttttagtatcaactattttgttgcatcctttctgcagagtgaaattttgcagtggagggatagccctgctgcatacctagagaagccgaggacatcaatgaggaaatcaaacaataaaaggaagagatgccaaaattgcaatttgcctactttgcaaataacttttttttttttttacaatcagccttgtgcattatggatatgaaggactataaattattcagaatgtttgattaaccaattactctcattcttccacagtgctagagttcagatttcttcttctaagacaaatgagaattgattgctacattcatccccagaacactatcttcctttctttaagtgataaattttggttttcatgataccaggaaaaaaacaaaaacaaaacaaaacaaaaaaactggattccatttgttggcgcaatccagcattctcctacgctgtttttccctcttatcctagccatttggactctaatgctaaactccctaccatccctactaccactaaatagaagaggttctgagtagtgaagttttatttttcataagtaaattaaaagaaagaggagagatatggccttaagtggccaaatgttttctatttcccctatgcacttccttcctgctttccccactttgcccctcttattggctcttcctagtctctggactgcatacttgaatctctgtcctgagttctggcttcatgctgtcactctcccctgctacaggcctgctcttttctctatttcgctcacctctggcttcctcacttgcttcctctacttccatctaaagagagttcaggaatatttttaatctgtcctactaggcccctgactacgtaagtttttggtgacctcaattacaacaggaaaaatgttatccacttctggcagtagaaggaacaaacaaattttaggtatctgtcagattacagacaggaaagagaacttctaagagttacagaccaagctttggatcctgacaactcagctgttaactccacaccatcccccacaacaaaatcttcctataattagggatgattgttaattatccatgggcattgaagcaaaatccaggacaaattgttttcactatagtaaggaaatggaaattaaaaataattaagtttgaaattatgaataccttacctttgatagccagtcctctcgagcttgaggttacaagggtaaattatgtaattctttctagacattttattatgttggatccaaatggcattttaatgcttttaatacagctaatgaatagactacatcaagtcaattattttgactttccatttctgacagcttttctcctgtgtgagcatagaaacaagagtttataggctcaagtggtcaagtagaacagcaagtgttgggtttaggagaaaaatttaaaatattccggacctgtctttccaatggaacacaacacttaacaaccaaataaaaaaaagagcctgaaatactctctgccacacttgggaaaatgttttatctttcttttttaacctgaaaatactccttccttttcagaaaacatttaaagacagtccttcttaagaccatttccaacactgtttatacaaaggccctaaaaatgggtccttctaagacacttccaggggtcaagcaagaagagactatgaaagtcttgatcacagctaacattcataggcaaaaatgtcctcagctttctcttttttcctttcttccaagttggctactgtctataaactccagaaattagtagtcaaagcatcccctaacccttgagcctgtgggaatacaggaatttcaacccgagcacgtcagtccccaaggcctcctttactcttggagaaatccctcacaacaaaggacaagggagaagcaagggggaggggcgcccagtggacttggctggaagaagtgagcgggctggggttggaagagtaactcgggctgcgggctgaacgcagtcggcaaccgcggaagagcagcatctcccctgcgcctgtggatacgccagtccagggatggcgagtgctttctcctccccagcttctccctcgctcttcgaggtgactcgtgggaccctgcgtcctagtgctgggtgtgaatcggctatttcacacccagttcttcctcccctccgccacacgcagtcacattcctggagctattccaagctgcctccgctaagcaccgaataagcggaccctgcctggaaacttgagcgaagctgaactgcgccgaactccaccgtccagtgacccgagccagtgtggacgcccttttaatcacgctgtttacccaggtggaatttaggaagaatcagccttcagcctcaacctcaaaccttttgtgcaaatgggcacttcgtttggaaagggactagaaattgtccccagtctggccctgcaccagcaccttcctctgctcaaacctgtacaaagtggaagttttaggaagtttccatttctcgtgccccgtttcaacttgctccccaaagagaacatgaaaacgtgggaactcgggaggacagagatctccctgtaatcgcctcgctattcggatcctgggtctcttagtctttctttatttcccaaataccgcccccagcacggtagaccggacccccaggcttgggtcctggggccggcgcagaggatcagcgcccaagcgcagccccccaccctcccgacccactgtaaacagtcgggcaccctccctcgcctccaggtgccaccccatcgccatcgcctctctcccagaaaaaaaagtccggagacaagagggcggggggcgggggacgccaggcgcggggggaacagagctgggaaggacgcagtctgaggccgaggaacattcattttctttctataatgcccattcccgaggccgagcctttgggcgaggtgtacgcgcccgcccgcgcactcacccatggcccgaggtcctgcttctctgcagtccccagaggagagcgagtgaccagacgctgcgcggggccaagttctccaagccgcgctgaggctcctcgcgccctggcaagtgacagcctcgcccctcccagcggagacaactcgcagggcgcctggcgactctgcgggcgcacagacccctccctctttccacctgcctcctctgcgagaagcccgttttcctccccttcactgtgggtctcctccccagaggcccccaccctgccccctttcactttcattagagacacgtgcaaagtctctctcctaaatacattgaatgcacattacagacacacacgttgtctcagcaccccacaaccgactcggtagccaagataatgatctctaagtggagtctggaaatagattattccaaaagacaggtttcatatgataattttatgttcccttgtcttctgtgtaccattttgtttcttaatgataataacattaataaagacaagaggaagagaaaattctccctttaatttatcctttgtcatctcctctttcttctacataaaatatgtttctgtaattggacaaggttataaagttctaaaaaccatacactcaaacacacatgcacacaccctgacatacacacacacacacatcataatatgcagaaatcacctggaaaataaacaattcaatccaagaggcagttgatgaggctgaaagagcacagggcttgacagttgagaggatgagttgtaatcctggctcatttcctaatttgtaaaatgaaggatctggaaaaagtgatctctaaggtctcctcaagctaaaaaaaaaaaaaaaattatataactctatgggttattgacctagttctttcaagagtcatactggagaagttatttcagtaagtcagtccccaaggtgtacacagctttttcatgcaaagcacacccaaaagtatacatatctatgctgtgagcaagtggaagaataaaataaaatggatatgattacttaccttgaggaacattgctatctaatggggaaaaggtgatatgaaaaataaataacaatatttttagcagaatgcatggataaatgcagagcatatcattcaaatgccacataaacatctgcacagctctttctcacgtaatggaagaggtatactcctggcaggggtgtgtaaatgcacttcagttacatgggaatacagttattcttatgggaggggaaaggaagtagtcaacaaaaattaaaagtgttcaacatatcattcagaaatgcatcacccttctagaaattgactaacatgaactgtgactgtagcaaagcataacactaatacatttgttcaataaatataagttgctggctcacacttgtacttctggcacttacagagcctgaggcaggtatatccctgaagctcaggagtttgagatcagcctgggcaacatagtgagacctcgtctctccaaaaaaataaacaaaaaattagcttggtgtggtggtgcacgcctgtagtcccagctacttgggaggctgaggtggaaggatcactttatcctgggaggttaaggctgcagtgagccaagactgcaccactgcacttcagcctggacaacagagtgagaccgtgtctcaaaaaaaaaaaaaaagataagtgatagattttggagattgattcataagctcagttttaggatcaccacaagcaacttacaatctatctcctgaagacttattcaaaataatatttgaattctaaaaattagaactgttttttgtttttttcccatcggattctatgataatcctgaaatacaaaataataattataacataaactgagtacagtgtgctaagtgtcaggcattgtactaagggcttcatattagctaatataattctcactaaaaaaggaaaatactgttatccccactttacagatgagggaattaatccacaaagagattaaacacttgcccaaattctcataataaatgggaatgcaaaattcatacccaggacaaaatactccagagttcatgatcttagtcagttaaccacattgtttctcagtatccaactggtttgccacatgcttgagaaagatggtgatatcttccaacaataaatataattcataattttttttttttttttttgagacagagtctggctcagtcacccaggctagagtgcaatggcgccatctcggctcactgcaagctccacctcccgggttcatgccattctcctgcctcagcctcccgagtagctgggactacaggtgcccaccaccacgcccggctaattttttttttttttgtatttttagtagagatggggtttcactgtgttagccaggatggtctcgatctcctgacctcatgacccacccacctcggcctcccaaagtgctgggattacaggcgtgagccaccatgcctggcctaattcataaatatttttaacattcccagtaaaatatatgaaatttagaatacactaaagatacaaatcatcatatactggcttttaataatcaaaatcatgatgttttctttcctttgccttattataagtgaatagatcaaaatgttgatgttgaattcatttatcttacagtgatgatgtaaatggtgtcagtatcctagatctcaggtatagagaggccattatctcccctgaaatctaacaagttacataattttatatgggattcaataaacatataaattaattcattatcttacttagtacattatttttttactctaattatccggtatttctgctttctcattcctgtcacctaattgtccatcaagtcctaaggttctgtttccaaaatattcttcccattcatcccgcatcttcagtttcattgcctagaccaccttttagcaagtcctgtggaaatataactaacacttctttttaaaaacggagatacttaccaaccatgggactcaaaattaaggctttagctaaacttgtaaaattctgagatgaatataaatttttcttttcttttcttttttttttttttgagatggagtctcgcttttgttgccctggctggagtgcaatggcatgatcttggctgactgcaacctctgcctcccaggttcaagcgattctcctgcctcagcctcctgagtagctgggattacaggcattttttagtagagacggggtttcaccatgttagcaaggctggtctcaaactcctgacctctggtgatccacccacctctgcctcccaaagtgctggcataagccaccgtgcctggctagaaatttttcatgacataaccttgttgaagccaagggaagacttcccctttactctctgaaagttcactgaaaatcaactgagcaaagatggataaataggagaaatggcatacaaatttattaatgagcacagagaaccatagagtgattacctcaacccccagtggggtagcaaatcttatatattccatcttgaggttacagaaagaattggggcttttatcatggcaaaataggatacggtggcaagacagcttatgggagggggagaagaggagcccgggcttgcaaagctggtctttctatgcagatgaaaccttgcagggctcagcccacaccaagaacacaaggtgaatgtttctttcagacttttaaaggtgtcagactctcagttaatctttcctatatccagacaaaggaaggtctcagagagggcctggctgcatcaatgcaggttttctctactgatgcgaatctccccccacaaaaggcagcttttcagctattcttgaatttccagcttttctgaatagttttcttgaaatatgtcaagaaaatatatttggagaggaaatattttagtttccttctgttcccctttggaagtttttctttaagaaagtttcacttattaaaggcaaggttgataactttggaaagatgtgagttaaaggttgctatttaggaggcaggcaaaggaggagaaaaacaagttaggataagcagaaaagaacaaatttaaatatgttatctcatatcttctcgaatcagcctcttagtcctgagaaaagttcagttgagttaaacagcagggtcccattccaggaggcggcatggcagatgggcttgacctccatatacagtgcagacaaacagatctttagtaagaggcatttctgtagaaacataaaaaaaacaaagattaatgtctggagtagtctataaactaatttttctagcatctctgaagcatctttagatggcaatctgacagatttttctggattgtagttcgaatcaggtattcaaatgaacgttcggcagagtccagacatcaataggcatgaagactgtttgtatgtaagtttctctagtgatttccctgaaagtttatatcatgttatctagttttagtttgcagagctttaaaaaaaaaagcatgtttttaatttctagtgatttcaatttagaaaaatgagagaaaaatttgaaaaccttaaagacttgtagccagaaaataattcagaatgcagtccaaattgtaggcaaataataaaaacttaaaaacaatggacaaggctaaaatccaataacaggcatactatagttttcttctgaaacatatgtttctctctgtagtcccctaggtctaccaaagataagacatagtaagaccaatttatttgcaacataagttttactcctattgtaattggcctaattatttgcacaaagtgcagtaagaacagtgattggctatatgaccttttttaaagttggctttgctggaacttttacataaggaatctcacattcgatttttaaaaacctcccaaggctgggaagccaaaccatggatttgctatgagactgtacccaatacctgtatgaactgggtacattccccttttctcaaggattccaaaatatcttgaggttcctgaagctgccaaaaagtgacattctacttgctgcaaagtcaggaaccttgtaagagaaccatatagacaagctaccaggccagtatttacaagggttttttttttttttttaatcagctctagaaagtcaacctcaattcctcaaagtagtaatatctgaaaatatgtcattccatccacagccttggtaaaatagtgtctacaattgtgtattattttgggaaaaaacagattcttatttaatttatgcaaattactatgttgccataaaataagactactcacaaatagtttctaaattctagtgacaccaggtagagaaaatggtaaatgtttccactttgctcacaaaagtatactttaccaattactgtaagctataaatagttcaaaagaaaaaaagagttttcttgactctagaaaacaaaacaaaaaccatcagctatatttcaaattttaaaaatcatagaaaaatcattcagttctctatcagttaagtcttacatgactaacgtttgttctgcttgatgttgggttagcaatcttcatgaactcattagttttttcattagacttctggaagtttttacctagtctaatggtacgaccttcaaagttgtcagaaacctgtatttctgagaatatttggcaatgtcctttccatgaatttctttgaaaaataagtacattttggactgtaaccaattaaaaataagcacattttgtactgtagccagttgtaaactactttttgagaagactcaaagtaaaacaatcattgtctgaggatgacaaaagatacagaatagccatggttaaagaagcaattgacaaggaaatttggttatttttgtggcatactgcaatttaacataattataatcataactgatatcatgtaccaagatatatcagaattttaggaatttcatacaattttggaacacattaataacacatttatacaattataactcaaagaagagttaagcacaatttcttatttgacaatatttctgtatgatttttacacatcacataagcctcatatgtctctcttggacttccaggggttctttatggaatatccaaaagtcagtttgaggtcaaaaagacttaattttagaatttaaaatttggtattggaagtttgtcaaatatcaaaggtttaaaacactttatattaaaaaaagaaagtgttaaaatatttgatcaaaataggatcacaggtcactgtaaataagttattcatttagccaaattcataattaaaagatttcaaaagcaaaacacttcactctttgatagagaggaggttcagttttccaatcaaagtacctagtaaagacagcatgagtcaaactctccctgctacttcttattttttgcagtttattcaaaaggtgaacaaaaatcttccattatactatctcttgccaatactacacgaaaatcatattcaaaagagaaaactaaaatatatctttgcatcagcattgttaatgttagagctaatttaataaaatactataaatagttccatttaatctcaatcagttttgaccacataagatttgtataaaacttttataacaaaaattttttcattctttttctttccccaactttctatatccatttagttttatctattattttttcccttcaattttaaataacatttatatggcctctgaactagacaaaaattaatttaccttttctttaacaaaaccacattctcacacctttgttataaccttccccacccaaaacacattgaactttccttatacatttttcatacagaaatgtttctcacatctggtagttttaattttatatactaattacaatgttaactcttagtaaccctaattttcagggaaaaaccttagaagttagcaattttaattgttatataccagacacagtgcccaggacctttcaagacaattcctggtgaatccaacttctttcaaggaggaaagacctttccagacaatgtctaatgaatccaactcctccctgcatggccatgaggcacagctgggtccggtaggatggggttcaagtgctgtgccctagccctcactgtgaccaagtgtctaaaccctagaatctaaagactcaaaaccaaagaaataagctcgcagacaaattaagcaagtatcaaatatatcacagaagaaaccattttttggccttaaaaacatgtagaagagacagtataaatttgtctgtccaatagatccaggcaaaaatgtgtgaattatatgtaatacctacaattctgaagacattctaattgtattttactaacagtttttaagccagttttatttaccaaagatttctcatgtcacatgaccttgaaaagcactgggatttaatctaggcatgagtgactatgggtcattgaatgagcattttatgttccagccaaatatcatttctacattgccaatgatttttaattcactgagggagaatgttcaataagaggaaaggaacactgacaatggagaatgggaacacacaaacatttaataactgtggacaaaaggagttcatgcagaggagtgcaaaaaataatcttaggctaggaaaagaatccagagaaagtcctgtagagaacgtttcaacaagaaagaagtgtcaactagataaaacagaaagagcgaagaagacgaggactggcaagttcccttcggattggtggttatgaagtcactggtgaaacagtagcaagagtattatggaaaagtgaagagcagagagataaagaataaggaaacgggtggtagaaaaagagtgtggacaacctatttacagttcacagtgaaggaaggcagagtgggcaataagtgtcagagaaagtttatttatgaaagaaaaagaactgtatgtttcatatgttaatgcatatataggtttcaatcttagagatctacttcttagagtagaatgaagagatactatctggaacacaggaggaggaataagccagagagaacaggcaaaattgcctaatcctctgagatagaaaaagaagtagagaaagtgagtgtaaagaaaaaagaagaaagatttttatttcagtatggagctttggagcagagggctgataacctcaggacctcatggaggcctgataacctcagtattccgtaggtatgtactaggaaggagatgtgctgagagagaacaaattggggctgcagctccacttaagaaaattaatgaagtttgttacagctgctgtagtgaagaggagagggaggtgaccacggtataataaagaaacatcaagtaacattgaagtccaagcagagactgaatctaaatttatagagacaccaatctataacttgactataggagaggataaaacagaaagctgaatttaaagaaaactgagagcatttgtgagtgtaatggtagagcggtaggaagaagaaggaggtaaggctgatggcaaaaactacaaaatgagttaattcatcttgggtctaaattagaacaggaagaaagaagaccccaggacagtagctatggactgtgagagaagaaggggacacagtactgaaaagataaaggaagtttaagagcagatttggcgtaaataaagcttgaaagatggggatagacagaagttgttgttcagctattgctgtattagaccttaatatttcagaggctgagaaatttggagtgcagagagatccagggaaagactaaagattaggtttgtaaagttcagcagaagtgacagttcctgctattgaggcaagtctttgaagacaggtgctggaagaattattaataaggatactacagtacaccacagtgattatatggattgcaaagaaagaaaaaaatgtcaaagtccaatttaaataagataatgcattagaaaggctgaaaattttaaacagttataaaaatgttagctgcaactatgaaaattgctgaagggaataaatgaaaacagtcgatgtataccataaatatgaagcataaattttcataatttatatacgagtaaggaccaagaggaaaccatggatccttgagcagggtaaccaatgataaaaaagatggggagatcaggctgattttccagggagtggaggttccatctacaagactcagatcttttttgtgtttgctttttgttttggtttggattcgtttttgctcatttgtttcagttttacaaagactgaagtggttgtttcacaaaatatatattgtacagatagtaccctcaggccttattttcccagccagaaacaccaacacaacagcttccaaatgcagtctcctttacaattcattaatttttgttctattcctaggatggcctcactgggctttggtttcccttgaggaaagtgattttcttttgtggtttgcagttgagtcacaagagaattttgaagggttttgagcctccccgttgcaaagctgtaggtaagtgtcttgtgacagctatagcaataaagcagagtggttttccttaacatttaaatgcaataattagcatatgttgttttaaattgtgtgtgtgtgtgtgtgtgtgtgtgtgtgggtgtgtgtgtgttttatatttacagaaccatgttctcgaagcagtccagtctctaaagtttcaccaggtggggcagagtgccaggcctatgactagggccagaggtctctcctcttgtctctctgatgaatactggcagttccccaggcttaccagttattctggagataatgcttttgaaggcctcaaaggtgctgaatatcatcttaatttgaaccccacagaaagagtttggacacctccattcttcactgcacaaagctctcttgaccaggcacctggctgatctctggcatctcggtgggctacacggagctcatggtcttcattctccaggtaaaaccagggagcacagcttgaactcctgacattctttcttgattttatcactgcctctcctgcctctgctgcccatctttttatgtctgatatgcactgctttcagctttatgctgttatgtttctggccaactggaaacatacatatctgcagatcaatggtgaggaacctcccagtgccccactgcagggtctggctgttatcagaagaggctgggggtctcatcctcaagcatattttgctggttgtgcacctttccgaactgcccagagtgaagggattttcatctggaggagagaccctggaggaaatcagtttcaacttgggctccaccaatgctgccagcattgtgggtagagagggaggccacagggccatactggagggctatgctgtaaggaggtggtcttcacctctaggcagattaggtgaccagcaggcactttcacagagccactggccttccactctgactcctggttctgcccggaccactgaattcttgtggcactctgactacatttttgaaaaaatttaatgagttcatgtgaatattcagtgattcatggattgggtagcagcagatcacaagtggttcagtgccccacagaaggggtcataaggggactttttaaataaattcaacttttattttagattcaggagtacatgtgcaggcgtgttacaccggtatattgtgtgatgctgaggtctgggctatgaatgatcctgttgtccaggtagtgagcacagtacccaatagatggctttcagcccttttgcctctaatatatgtctactatatatataaacattatacatataaatatataatatatatattttttttcagccctttcccgtctagtacctgtctactatacccatctttatgtccatgtgtacccaatgcttagctctcacttacaagtgacaacatgtgatacttggtcttctgttcctgcattaatttgcctagtataatggcctccagctgtatccatgttgctgtaaaggacatgatttcattttttgcggctgcatagtattctagtgtatatgtagcacattttatttaacctattcaccactgatgagcatctaggctgcttccatgtctttgctattcttagagtgagaattaaaggtgggaatggcaggctcattgaaactctgccgctttgaggtggcagagatctcatgctataccttgcaagtgaggaaggagtacagctgttggtgggatgagctgaagccgaggcttgaggataatggggtagtgctccatctcagatctctcgtagcccaggagcagatggatggtcattgctttggcataattctgacccattaacaagctctgaatctcttcgcacgtataagccatgggcattatctcagtctgtcagggattcttaaaagcaggaagtggtcaatgtaagagtttagatttcagttcctcctcgtggtccatgttcatccacggatgcttcatgatttcctctaaagtgcctctcctgcgagagttgaggacaagaaatttcttgagcaggttttcacactccatgggcatatagcaagaaataccagatattcttctcaatatctactctggcaactccttgaagttctgtctatcacaaggcagcaggggcacactgagcagccgatagaggataactgccagtctttactcattcactagcagctgttgtactttgggccctggaagagctgtggggcaatataaagagggctgccacagagggcagctagcttgttgccaaaggtgaatttgttgtgaagctagcctacaatgtcagctgtgcagatgttctgcccacaggtctctaaggaccatacacctctggtggtaacactgcacaataggcacttcatggcaaaattcgccttgtgcttttttctctttcatgctgccatcagccaccaggtaatggaacaccccctcctccaccaacatactccacaatactgtagaggattttcttaatgtcaatcacttcagataatttcactatggtgggttgattcaaggccttcttgatttggtttttctggaacagtcacaggaggctgggggagttctgctgagtcttactgatggtctttgcagccacctctttcccagtgaaaatgtgccacaccaatttcaccttggtgaagttacccccactgatggagccagtcgactaaggagccagtcgttgccattatgggtctcttcctgaatagagatggctgagaggcactgcagcatgttgggcttataggcaagttgtcacaaagtcagcttacaattgggaaaagctggtgagaagcttggtccaaatcgcatcaacagaaactcaggcccagagtctacccaatgaactggtcattgagaggaatcaaaacacaacaccaaacaaaaataaaaagtaccagaaattaacaataactaaacaaaaaaatgagagaaattaagaaaagaaaaatgagaaaaagactgaataataaaaatgagaaaaataaaaatgaaaaagggcagtgagaaaaaagaaagtaagaaaataataaaaaatgaggaacagaaaaaaacagtatagaagaaaaatttaaaacaagcaaaagagaaaaaaagccaaagagataaaaagttaactttggtcaaagtctctcaggtcatggaaaaccagcttcctgagctggaagcaccaaagtttagacccagaagttgtaggttcttagaatttcataaaaatagctccttatgcaggttatagcaagaaatgaactatcactggtaaggataatccagagtggttttcttacattttggttttggaacacatttctcttaagaggggggttgaggtgttcctaaaaagcttttaatctgagttatattgatcaatatttacctcgttagaatttaaaacctgcagagtgtttcagtgactttttcattcctagtttggaacttacaataaactttggcttttaaagagctcatagtatctacatttaaaatatataatttctttctttctttctttctttctttcttttttttttttttgagacggagttttgctcttgttgcccaggctggagggcaatagtgtgatctcagctcactgcaacctctgcttcctgggttcaagcaattctcctctctcagcttcctgagtagcctgggattacaggcatgccccaacatgcccggctaattttgtattcttggtagagacggggtttcaccatgttggtcaggctggtctcaaactcctaacctcaggtgatctgcccaccttggcctcccagtgttgggattacaagcatgagccactgtgcccagcctaaaatttataatttcttttttaaaaactctgaatggttggtctcaaaatgacgtcacaacttagctgacatcatgatactatacaaaaatgttccattgcataggacacaatcagatatacttaggtatacattattaggatttttaaagctgaggggaagatagcttccatcatactctcatttcttatttaaagctttgcctttctttggagaaaattcctcccttccatgagatagatgattcattttgttcatgtcagtattttcaaatgtagaggttgcaactgtcagttgagaaagcaagtttctctttttcttttttcttttttcttctttctttctttctttcttttacttctttctttccttctctttctcctctctctctgtctctttctttcttgcactttatagactatttaaaatagtagtttaggttctcagcaaaaccgaatggaagatatggagagtttccatatccccctacccaacacatgcataggctcctccactatcaacattccccataaaaacagttcattagttacaatcaatgaacctacattgacacatcattatcttccaaagtccatggcttacactgtggttcactcttggtgttacatggtctatgggtttggacaagtgcataaatgacttgtacccaccatcatagtatgcagaatagtttcattgctctaaaaatcttctgtgctccacttattccttcctccctccccactaactcttggcaaccacagatccttttaccaactccatagttttgccttttccagaatgttatatagttttaatcatacactgtgtagccttatagttaaaatcatacagtattggctccttacacttagtaatatgtatttatggttcctccatgtcttttcatgcctagatagctcatttcttttcagtcctaaatactatttaattgtttaaatgcaccatagtttatccattcacctactgaaggacatcttggttgcatccaagtttagacaattatgaataaagctgctataatcatccgtatgcaggtttttgtgtgcatataagttttcaacttatttacgtaaataacagggagtgagactgctggattttatggtaagagcatgtttagttttataagaaagtgccaaattgtctttcaactagcagtgcgtgagaagctccagtgtctccacattcttatcagtattttggatttttgccatctcacagttgtgtagaattgtctcattgttgttttaatttccaattctctaatgacataacgatgtggaacatcttttcatattctcatttcatatattattattatctctgattaggtgtctgttcaaatcttttgccttttgtaaatcaggttgtttttcttatggttgagtttttaaagttctttgtttattttgactaacagtcatttatcaaatagtttttgcaaatattttctcccagtctgtgacttaagactcatattttaattattattatttagcatatcttaatgattaaatattaaacaggattatacatttaaagtagaccacatagaagctgcatatgtaagtattgtttcactagaaacaattgtcacttaagtttctgtgatggtaagaatgagtactcactggtctccttaatagtaggtgaattggcatgaatctgtagaggtgtatgcatgagacaagaattttccagttttacactttttgcacattggcaagatattatatgatcataaacatcactaaaatatacacgtgctaagctttagggctttcagataaccaccagtagttttgtattgaattacttggtttaaagacaaagctcagatatgtgttcaatgatgaaaaagaagtagtaggaaatccttttcttctttctcaagaacattagcacctcttcaaatacattgattatagaacacagacagcccttgcgatagtttgctgagaatgatggtttccagcttcatccatgtccctacaaaggacatgaactcatccttttttatggttgcatagtattccatggtgtatatgtgccacattttcttaatccattctatcattgatggacatttgggtttggttccaagtctttgctattgtgaatagtgctgcaataaacatatgtgtgcatgtgtctttgtagcagcatggtttataatcctttgggtatatacccagtaatgggatggctgggtcaaatggtatttctagttctagatccctgaggaattgccacactgtcttccacaatggttgaactagtttacagtcccaccaacagtgtaaaagtgttcctatttctccacatcctctccagcacctgttgtttcctaactttttaatgattgccattctaactggtgtgagatggtatctcattgtggttttgatttgcatttctctgatggccagtgatagtgagcattgggaattgaacaatgagaacatttggacacaggaaggagaacatcacacaccggggcctgttgtggggtggaaggatggcggagggatagcattaggagatatacctaatgtaaatgacaagttaatgggtgcagcacaccaacatggcacatgtatacatatgtaacaaacctgcacattgtgcacatgtaccctaaaacttaaagtataatatataatacttcatataatatatatatattatacttatacatatatatattatacatatatatatattatacatatatatatgtataaaagaacacagactgccaactgggaaaagagttttccaacatctgcatccatgaagacgttttcaaatgatgtaaaagcagattgatgctttcactggatttgtaacttttttttttaatacagagggatttgtagccttctccttcattaaacagtattaataaaatcacctctaagtaaatgaaatccttatggtttttattaatgatattaatttctttttgaggtttccacaattgcttttaaaatcaagtttctaatatcctctactcttcgtacatctctaattggaaaagatgtaagagcattagcaaaagctaataaaaatgctcttatatgttttcaaaataaatggttaacaatttaacatctctgatattcctttcaagctaccactattcttttgtatattgagtcctataaattacagaccactatttcatgcactaatacgtgaaataattgctatagctaaagataaatgctatagctaaagataaatgcgttggtgggaaatttttaatctgaacttttgtctaatattgtaaaatatatctgctaatcttggactttcatgtaaagccatcctgcagcaatgtaccccttaggcacctttaactacacttgtggtcctcaaccctggccacacttaccttaattttttttttttttttttttgagacagggttttgctctattgcccaggctggcaggatcatagctcactgcagcctcaacctgctgggctcaagtgatcccccgcctcagccccctgatatctgggattacaggcacatgccaccacacccagctaatttttttttggaactttttagtagggacaaggtctcactatgttgcccaagctggtctcaaactcctgagatcaagcaatcctccttctttggcctcccaaaatgttgggattacaggtgtgagccaccatgtctcaccttagaattttaaaaattatacctggacaccaccccaacttaaatgtgttagaattcctggtgatgaatattttttgaaagcttcctgatatgaccatggttgacagtcactatgccagatctcttcatctacttcctggatttccttccctcacttttaagaattctaaagctgatattttgtgttacatgcattacttccagtattagctgctgctaatgtttattcaataagtattattgaatacactttcttagcctctttacattgctattacctgaaaaccttacaacaaaacaataaataaggtgttcatgttatttctacatacagatggaaacactgagattcaaatatgttcattgtcttctccaacgtgttcttttttgcatgtttgctgttgacctcaagaaagacttggaaataagaccataatctgtaattttttttttttttttttgagacggagttttgctcttgttgcccaggctggagtgcaatggcgggatcttggctcaccgcaacctccacctcccaagttcaagtgattctcctgcgtcagcctcccgagtagctgggattacaggcacgtgccatcacgcctggctaattttgtatttttggtagagacagggtttctccatgttggtcaggctggtctcgaactcccgacctcaggtgatctgcctgccttggcctcccaaagtgctcggattacaggcgtgagccaccactcccggcccatgatctgtaattttaatcaaaagtgttaggctacatagtgcattgtaaattttcaattatgcctaatataaataagcacaaccaacactatttttcaaagtcacataaaagtgtttaagaaatcacagaggctctccacataataaaagtaaaagtgtgaaaggcagaatttagaatgatttgttagagaagaactgtaggttctgcatataaaataggctcatttaacaatatgccattctgtatgccccaaaggatatgggggaaagttaagacacttcattttaaatcaattgtgaaatgtggtttaattatcagaagcaaatgagataattttttccaccaatagagcagttttaaatgttgttcactttattttagatattgtgagcataaaaatgatttgctaaacccagacaaaatttttgaagagtttcctgaatccaaacatgtttacactataataaattatttccaagacaccaggaacaccatagctaaaatacaattcaaatgagatctacatttaatgtagaagaaccagacatcccttatctatatcaactactaatatccctgctgtgaactataaattaacgaggttcattttgtgtgtgtggccatggagccaggcttccacgccccatttaagccgtatcagtcatacctcatatatttatttaacgaagataagcactttcaagttgcttcatgcatttgcatctttgaaggcactgtatattctatttttactgcaacatttgagttctggttctgtattttgtgttgataaacctaaatacggtttgaagttattttgattccatttatatatttgctttaggcaactgggggaaggaaatacatttgacatcagaacactcaagtcttatgaggaaagaatcacaggaaagctcagatcagctgtaagtaataaacatgttttattgtaatgcctactatgagccaggcctgttgcataaacataaaataatataatcttcccaacaaccctgagatgagtgtatcattgctattaatttctaattacaatgttaacttatataaatagaggcagattaggagaagttaacaagcagcagagtgagtctgaaatcccgaagtaactctatagatctgctcagtgaaggaaaacaatgggccgggcgcgatggctcacgcctgtaatcccagcactttgggaggccaaggcgagcggatcacgaggtcaggagatcgagaccatcctggctaacatggtgaaaccccgtctctactaaaaatacaaaaaaattagccgggcgtggttgcaggcgcctgtagtcccagctactcaggaggctgaggcaggagaatggcctgaacccaggaagcggagcttgcggtgagctgagatcgtgccactgcactccagcctgggcgacagagcgaggctctgtctcaaaaaaaaaaaaaaaaaaaagaaaacaatgatggcattcttaacagaattctgaacatgtggtccaaatacaatggtggaagcttaatagtaagaaatgagttagtccaagatcactaaagggctcttgtaattcttgattctttggactgaaagaggaacatctggaccacagcaggaagtgagagcttggaaaatatcctctcaggagcatggtggagattggcagtgtttcagagcaggagagggctgttggaaaccatctgattgacaatatgtaataacttcttaatagcatccctgcacctcatcattttatcatctactctttagccaaatttgtcttcctaaaactggaagtctggttatgtaatttcctgatttaaaatcttccacctaaacattaaagtaatacccaaacattttaaatggcccataaagcccttcaagctattgttgccttctgcttaatcctccagcctcacctcattcggttgccactccctgtattgagccttttgttcaacctgcacataatcatttagatatcattatagttcctataatttgccacacattctcttcacacatttaaatatgctgttcttctggcttcaaataattatttcccccatgaaatgacctcccctcttctcccctactttgatctataaacaactactatcttcattttccaacttggatttgctgactatccatgacctagagacttggtcaggcacatctttcacatgctccaagaaagccctgtgttcctcccatcatagattgcactgtaagtccatctgtaattatctgtgtctttactaaattataggctctgggcgggcaggaaccaggcttttcctgctcatcactgtcttcccagtatgtagcacaatgcttgggctcaacacttgacttaagttggttttttgagacaggatctttttctgttgcccaggctggagtgcagtggcacaaacgtggctcactgcagccttgacctcttggtctcaaataatccttctgcctcagcctcccatgtagctgggaccacaggtgcacaccaccactcctggctattgtgtttgtttgttctttgtagagacaaggtgtcactttgttgctcaagctggtcttgaatgcctgggttcaagcaatcctcctgcctcaacctcccaaagtgctgggattacaggcataagccattgtgcccagcttgaattaaaatttaatacattcatacaatacttcaggtatcagagacataaaagatttttttaattcatgatccctcatcctccagcttgtgtataggagaacactccctcctggagatcttaaatagttttccttaactcatatatttcattagtgcttagtgaatataaatctcggtccaaaaattcagatgtgcaaaaaaacccgttgttttattttctaaaaattatcttaactatcaacttaaatctaaattcccctgagatggcaaggcactcaacctcagggttctatgggctttctctgtggagcaattgcaaagtctatggagtcttaacagtctaatttttttaagtcatgctttcaggcttccatatcgccttttccatagtcctcctaaccagccagctctgcagctttcctatcatgcttggctctcacctctttggagaagatgggtatactgaagcttagagtcccacctgtcataatgcatcactctatcagctcttctgaggcctggccacctcctcagagcactgccctagagcaatgtcaaattccagctgatcttttctccattccctcccaattggaagcctcagaatatattatgtttaatattgaataaattgttatttcccttttcacgtttctcatagaagaattctttctcctcattcccttctctttaaggcacttagacttcaggtcacaaaagccaaaaaagaaactgaactgaagacaattttagctttctaatttggttagttggaatttttctggtagcaggtgaacatacccccaactcatacggccttatgcataaacaaaaatgaattggtgacagcactgagaatgtcaaggtatagttttggctcccagcaagctgggtttcagggctcaaattaggtcatcagggttgggttttcctctatgggttttggcttcattcttcttattaaatttattctctgagcgattctccaatcattatctccggttacactgccatcttagcttcaagtccattaaggaagagaatgagtctcctttctagaacaaccataaaaatgaactttattggcacttatttgacttcgattggatcacattttcacccctgagttcaatgaccaaggtaatatgatgcactgagtgagttaaatccaggtcccatactttacactggagctggggatgggagttacccaaagcatatgggctgagaggggaatagtgtcctgaggaaaaatgaatatgattactgaaaatgggagaaattaatctagattgcatacaaaaataatgtattttcttacagatagtttcaataattaggtgccaacagttcctctcttccctgggtgcacatgctactcatcccatcaagaggtggagtccatttcccctccctttgaataaggctggctttgtgacttgctttgcctaatagaatgcagcacaggtagcccaagtgggagctttcgggcttattaagggctaatcctcaaacttcagagctctcttaaatccttgagcctctaggtaaaatattcaggacatcctgatagaggagctatgtggaattacacaccatgtagagaatgaagtgactcagaattaaggccccaaaagtgagagaggcctgcttggacctcccagctcagtagagttatcaactgagcgcagtcattacagaccccagccaaccccacatggcgagaggaacaactacccagccaatcagtcctgagaaatagtaagtcactattattttaagtcaacaagttttggggtggttacacatcaaaatgcaactgatatactgttttaccctctgagagaaaactccacaagatgaggaaacacagaacctgtcacctgctaaaaggagaaggagaaaaccagcagccttagtgctatttatcaacccactctacttgtaagcaccctggcctctgtctcctaattcagtgctcttaccactatggttcactgtcatccaaaaaattgtgccttaatattcagaaaagcatatacacttgctaagtgtgaatagaattggacaaaaaggtgcatgggcaatttagattctgacaaaagaataaattagagagctaataggagacagaaatctttcaaggaaaagaaactggactgtagtgtgacaaacattgtaaaactgatttgattatttgtactggtcacagccaactgctaaaattatatggtggtttatcttacagcaaaacagttgtgaagtttaaacccctgttatcatcgttatttctcttttgcttcattaatccttaaattatatgaaaaaagcttcaagctttactaatgaatcacttcaaagaatgagagatgtcttatctgttggctgtaatgatgttaaaaattacattgactaaagaatagcacttaacttattaaataacttttatatatgaaaggccttgttcatttcagggacagtaagatactaaggctaagattgttcagagtttggaaaatgtgactttaaaaatagaatattttgaatccttacacttaaatatacttaagtttttttggtcaattttgaaaagttcttgatgattacaataaagtctcagtagtctactctgtaattacattcaatctgtgaaaattacataatttaaacatccatctctgaaaataaaactggtcctagttaatcaacagaataaaaaagcaacccacagaataggagaaaatatttgcaaattatatatcacataagggattaatatcctgaatatagagaactcctaaaactcaagaacaaaacagacgaacaaactgcttcaaaaatggacaaaggacataaatagacatttccccaaagaagatatgcaaatgccccatgagcacatggagagatgctcaatttcactaatcattaggaccatgagcacatggagagatgctcaatttcactaatcattaggacaatgcaaatcaaagcaacaataaaataacaactcgtacctattgggatggctactatttaaaaaaaaaaaaatacaagtggccgggcgcggtggctcacgcctgtaatcccagcactttgggaggccgaggcgggcggatcacgaggtcaggagatccagaccatcctggctaacacggtgaaactccgtctctactaaaaatacaaaaaaattagccgggcgtgatggcgggcgcctgtagtcccagctactggggaggctgaggcaggagaatggcgtgaacccgggaggcggagcttgcagtgagccgagatcgcgccgctgcactccagcctgggcgacagagtgagactccgtctcaaaaaaaaaaaaaaaaaaaaaaaaaaacaagtgagcaagaatatggagtcattgggactcttgtgcattgtgaatgggaatgaataatggtacagccgctgtggaaaacagtttggcagcttctcaaataattaaaaataaaattactatatgatccagcaattccatttctgggtatatgcccaaaagaattaaaaacaggatatggaagagatatttgtataaccgtgttcatagcaacattattagcaatggctaaccacagaagcaacataggtgtccatcgatggatgaatggatagggaaaatgtagtatacacgtacaatggcatattattctgccttaaaacagaaggaaactctgacacatgctacaacatgcataaaacttgaggatattatgctaagtaaaataggccagtcacaaaaaggcaaatactgtatgattccactggtaggaaatacttagagtagtcaaaatcatagggacagcaagtagaatgatggttcccagatattgcggggaggatgcaatgaggatttatagtttaatgtgtatagagtttcatttttacaagtttaaaagagttctggagatggatgatggtaatggttacacaatgttataaatgtatttaaaactactgaattgtacacctaaaaatgggtaatatggtaaattttatgtttatgtgtattttaccacgattttatgttatgtgtattttaccacaatttttaataaataggggaaaaactagttctagttaaactacaaaaagatcaggtcaagaatggttagagattgggaaaaagaatgagaatagagcaaatgtggaggtgagaatagatgggatggggtaattataaaggttaataaaagataaagctataaagcaagggagaggtgtgtatacatgatttctctcctcacaacattatgatttgccctctttgctacaaattctgttacttcattgtggtgtcattcaatctcatcttggataaaaaccaatgttaacattctttcaataaacttatttccttaagctttgaaaagcaaaataagaagagacaaacaaaaaaagtcagttaaatttgaattatcaaacaccatggaatgtatgtatatggtattataaattatcccagtgagcaaatatgaagagcacatttatggtaataacaaagtatagatccagaactacaacaacaaattataggtctaaaaggacagataagaaagcattaatcaagccctcatatgggcattgtttaaagatagagttaataataaaatcagtactatccttgattctcagcaaaccatcaataaatgcccttccagagtttctcaattttatttccaattttatcacaaaataagttttatttttgttttattatttttattattattattatcattattattattatggagataagatcccattctgtcacccatgctggagtactgtggtgtgatcacagctcactgcaggcttgacctccagggttcaagcagtcttcccacctcaacctcttatgtagccggaactacaggcatatgccatcatgctcagtgatttctttttagagagagagagatagggtctcactatattgcccagattagtctcaaactcctggactcaagcaatcctcctgccttggcttcccaaagtgctgggattacaggtctgagccacatgacccagataatttttaaaattttttgtattatcatcaatatatatcatttttaaaagacgaagaccttcttcattccttttaactgggccactacaatttagcaattaagaaaaccccctagaatataagtatgttgatttacatatctactcaggctggtaaattttaaaactgccagtatcaagactacccaatcatataattttttaatttttctcacagtagtgttgtcactaaagtgacattttccttaagctaagattcataatgcaaaagttatagaaaactcttcgctgtattgtgtaataccaactatatggtgccatatagttaggaacaaagacaaattaaaataaacataatttgtgatttttaaaaaaatgtctacagctcctaatctttgctgctaatatcagggtactgccaagaaactgactcagacatggcgaatttaagctttagtaaagaaatctaaccccaagtcagcaaatggaaaaacattcatctgtcttaggaatatcccattccatataaagaaaagagtcacactcttaaaatattcagcacatttaaaattatttttaaatatatgactaatgcaaataattgcttactataagatggaaatgaactataaaatcagtagctttttaccaaatgatctatgcaaattttagagaacttttagataaaactagcagtggagaaaaaaatgagaacataaaaatccattaagaaaataattaaactagggaaagataaaaacaattatagaatatatcttatttctgattaaagcagaactattatgaaattagatcattataatttggcaaccatcatagtaataatggattccaaaagaatcatcagcatatgctaaaactaactggatgaaagtcagatgagtaatagaatatttatgtactttcgtttcaaatgatctctcagaatgcactcattaattacaaaagaaacaatacaactttacatggggacaaagaaggacaccaaattaatgaagtgatcaaagttaatatcactggcaattggacaatccgacattatgcacctcctgatgggaagcatgggaaacacaacatgtttctgcaatgttcctgccaaaaatccgtgagttgaatctagtcatgttgaagtgcctcagaaagcatgtttaaggacgttctctgaactagcttgcctactgtatattcttcaaaagtataaagactatgaaaacaaaccaacaaaaaaccctggggaatgttgcatactctagcaaaccaaaaagacgtgcaactgagaaccacttatgatccaacaatttcttttcctacaaaggacattattgggacaattggcaaaatgggaatgtctttagatgagataataatatcaatgctttttcctgattttgatcattctactttattttacttatttattcattttttggaaataggggtctcactaatgttgcccagcctgtattggaactcctgggctcaaaggatcttcctgcctcagcttcctgagtagctgtgactgcaggcatataccactgcacctggcttgataattatactttagttctctgacaaaatgtctttgattttagaaaatattcactaaaatatttaggagtaaaggatcatcaagtctgctacttaatttcaaagacaaaagagtatgtaaagggaaaattgtactctgtgtgtgtcatatgtatgtgtgtaatattacatatatacctacataaaagagagaaagagcagtaaagcaaaacaaaggcagcaaatgttaacatttagggaatctagaaggtttgtttcatattcttaccatcttcccatcagtctgaaattatgtcaaagtaaaagctgaaaaaagaatgaagcatgattttttgtcattttcaaatactatccgttgttatgatcttgccaaatatattttcagtcaaaaatccaaaattttataggtcatttccatttaatcaaagatattaacaagaaaatagttatttttgcgcaatgttggaagcctgtgatatgtattactctaaattctgtttgcatgtcctcatgtctaagcacctggtagtttttgaaatgggtaagtggcaaatagctgcaatacagaaggatagtattattaacctatctgaggtaaccatgttttgaatagcaaaatatatgtgcttgtaattttttaggctactaaaaagctgtaatattgacttaatgtcagtggataaatgagagaagaatatcttactgccctgaaattatggggcaccttgatttagagaagaaaaataaaaacaacagcaaaaactctgtttcatgaacacagctgcattcagagccctaacagtataaaaaagatgaatattcatcttgctcttaatgaactttccaattgattgaggtaaaatgtatgcctgaaacatatcaagtacaaatatgtatataaactttttttaattatgaaaaaagaaatattgcttcatttacatatctttattgatacaggagatttttctttttaaactgatattcaaggtaattgatacttggttcatcaaaataagttttagcaattgcttcttaaaatatctccaaaggcattatttgacttaataccagatgtagggccattcatgaatattatttcttgttctcttcaggaacagaggaggtttagttcctaggatttttcttacctatgatgttcaatttattgattctttcagccttccctttttctgagtacttcaaatgagccagaatttggtaattcaaatgatcgttagaattgctgacaatgaagaattagtatgctctgaagttggtctgtagtcctttgattcaaaataaaattgtgctagttctagtgcttataacttcagatgacacagaatcatttatagtattattttctgattcttggctacagtcttagctgtagatacagtttatgttactgtgattagcgcagcataaagaaatgataaagtattgatggactgaaaagcagttttctatgtgactttaaaactaagtaatcaacataattggtgatgagtagtatagagaatattctattaactttcattcaaatggcaaaaaatatatctgtagattatgaggtaagaaaaacatctagctaattttatgatggtgttttgatttttaataattgaaagataaaaaaatacacatcgattccctattctttttaaagaaatcagtgacaggtagtaaaatgataaagtctgtatttctcataacataactaatactatattcaattaataaatgaaaccaatctaagaatcttatagtgtcctgaagttgttggggaatcatttttatcccatgctggtctttgtttatctggcaattgtaaggtagtggacaaaaatgggatatagaaacatcagagaagaatgagaatgactaagttagtgttctgaatgtttagagtggaggttttatttagaaagtgcagtgaggcacatacagaatggattcatttttaattaaagctctgacatcatgaattataccaatcatatgtgatattttaatgtaacaggaccacttgtatgcaacaacaacaacaaaaacaaggctgggcacagtgactcatgcctgtaaccccagcactttgggaggccaagccggggggattacttgagcccaggatattgacaccagcctgggcaacataggataaccccgtaactacaaaatgaaaataaaaataaaaagttagctgggcttggtggtgcacatctatggtcccagctacttggggaggctgaggtgggaggatcgcttgggcttaagaggtcgaggctgcagtgagcattgcttgcaccactgcactgcggtctgggcaacagagcaagaacctgtctcacaaaaacaaacaaacaaacaaaaacggcaataaaaaaaacaaaccgccgttaacacatactaagtgcttaccatgggatgtatgactttacaatggattaagttctcatctatttatgaagtgtaattatgaagcaagaggtagcttggtcacattaacattgctaataagtccttaagcaacttctactacagaagtgcttctctaatttgtccaaaccaacacagcacttggtattctgagtagtttctaatcttcctgccgctcaccttatatccttttttcctgtttttgtcatccagtcaacctgaagattaatgcagcttctgtagccctgatctcctgattccctgttcaacccaatttatatgcagcctgaggctactctggagagatactttaacacctcctccctcgtgcctggggccttatacaatcatcacaaccagcattgctgctcgcttgcccaggcctgtgaatgacacatgttattactactctatttctacttcatgaaattaggtaactgggtcatttacttgtgaaaggactgcctgtagtgtgatttcttttaactaaaactttctttgcgaggactcaagtattgtatttggctgctctttgtctttcagagattggatattatgggtattatgttaatttaaaaaggacattcattcatttaataaatatgtcttgtgcatcaataagtacatagtagaaatccagtcctaaatgctgtggatataacagtaaacaatataaacaaagtccctgcctttatattctagtaggaatagtgagaaatagacagatgagataggtagatagatagaagatagataaatgaaagagaaataggagagaaatggatgatgatagaaaacagattagatggatggatagagagatactagattggatggatggatggatggatggatggatggatgcatggatggatggatggatgaatagatagatgatagatagatggatagatagatagataatagaaaagaaaggaagaaaaagaaaatagattaggtggatggatagatacagattagattagatagaaggatagttagctaatagattagatggatgggtgggtggatagatagatacaaagataatagattacatgaatggatagataatagattagatatattgacagatgaataatatagattggatagatggacagttaggtaacagattagatggatggatagatgggtgggtggatagacacatagataatagatgagatggatagataaataacagattagatgaatgggtggaggaatggatagttagatgatagatagatagatagatagatagatagatagatagatagatagatatgatatgataggaagatagataaacagatatatatcaagtattgttgactgctgcaaaagagaactaaaacaggataagaataatagaaagtagcagggaaagagttgctattccatatagtgtggtcaggaacatctccttgataagacaacatttcatcagagacctgaaggaagcaaaagaaaaacacatgagcttccacacagcaaaaatactatcatcagagtaaacaggcaacctacagaatgggagaaaatttttgcaatctatccatctgacaaagggctaatatccagaatctacaagtaacttaaacaaatttacaagaaaaaaaaaaccattaaaaagtgggtgaaggatatgaacagacacttctcaaaagaagacatttatgcagccaacaaacatataaaaaaaaagttcatcatcactggtcattagggaaatgcaaatcaaaaccacaatgagataccatctcacgccagttagaatggcaattattaaaaagtcaggaaacaacagatgctagcgaggctgtagagaaataggaacactttcacactgttggtgggagtgggagtgtaaattggttaaaccattgtggaagacagtgtggcgattcctcaaagatttagaaccagaaataccatttgacccagcaaacccatttctgagtatatacccaaaggattataaatcattctactataaagacacatgtacatgtatgtttattgcaacactatttacagcagcaaagacttggaccagcctaaatgctcatcagtgatagactggataaagaaaatgtggtacatgtacaccatggaatactatgcagccataaaaaagaatgagatcatgtcctttgcagaaacatgggtgaagctagaagccatccttctcagcaaactaacacaagaacagaaaaccaacactgcacgttctcactcataagtgggagttgaacaatgagaacacatagacacagggaggggaacatcacacacgggggcctgtcgtgggttgcgggggtaagggaagggagagcattaggacaaatatctaatgcatgcatgtatgtggggcttaaaacctagatgatgggttgataggtgcagcaaaccaccacggcacatgtataccttggtaacaaacccgcacgttctgcacatgtatcccagaacttaaagtaaaatttaaaaaatgaaaaagaaaagaaaaacacacatagaaatctgggagaaaggtaagttaggggcaagggcacaccaaataagaccagtgcttagagactaaattttaaattacctatcttgttatggatttcatgtaaagaagatattctctagtaataactaagaaaatgtgggtgcctatagcagcagtggataacatttttcccacgatatgaatacccggtaggccccacagcatgagaagatacatctacagcgttgcagagagcctcctccacatgtttaatgccaaagagaaactttaagtgaagcatatttcatttcttatagaaaatgaagatttaaaaccctaaagaaaattctgattcacttgaagaatctgctctcaaataattgtagttgaaatcacattcccaccagaggtcagcctaaccacaggaatgaattgttaattggcaaagcaaactggtgttgattttttacaaaatataatgctaatgaaattgtggcttaaatctctttatttctttatgttgttttgtagtaactagctacttgggtgacaaaccatcatggtttgagcagatcctttaagtgaatccaatttttcttcaggtaaattttccttttctatttgtaatgaaatatgcttcacttaaagtttctcctttggcattaaacatgtggaggaggctctctgtaactatgttgtaaatgtaccttaccacgctgtgaggccatgttatgtgctcacatagtggagaaaattttacccactgttgctattggcacccacattttcttagtggggctgagggatttccaaggagcagggaggtgggcctttcagtactggaaccaggaaagtcctgagctaatcaggagcagctgttgactctattggagtgacttaagcgtttgcgtttagtcagatttttgttttttaatttagacaaccgggcaacacagagttccgattcagaaggtataggaaactgaatttttaacaagctccttgacaatttgggtacaaatagcccttgtttcaaaaacactggttacaagatttcctatttaaattatctgaaaggggggatatgttatattagcctaagaagagaaacacacatattaaatactaactaaacagaacaatatattactataaccttattttatcttttcccaaaaaaattgcttttacttcataatgaagaaattatttatcccctattaaactgagttatttataaaaatacatattttatccaccctttagaaataaaactcagttatataaagtgtatattaaattataatcataataatgattattgattgcctaccatacactagctgtgtcctagcacatttatatcctttcctaatttaatccttaaaataactccgtaaaataggtaccatttttcacacttcacaaattaggatactgtagctcaaagaagttaagtaaatttcttgcaccacaagcctagaaagtgacaacctggagcccaaacatatgtctatggcttaaaattcattttcttttttctgaaacaaccatggcaactccagactttaccctttttacatttttcagtgtgtctctccccaggcatttgtggagaagttacagaggccatcctcgttacttacaaagtgaatccttgatatatttttcccagcagaaataaccagatacagattctctacctctgagcaaaagcttcaagccaaactctcaaactcgctcatttattgttctccattgacttaagtccaagtgctgtcacctttgagatttcagatttgagttataaattatctcattattaggcctacagagaaaaaattgggtttaagactgtgctgagtcagatctaagttagtttggggtgataatgtggactattatccagttaggattggcccatggattgaaggactgcagtctcaccaagaagtgggtctaaactaggaaggaagtgccagtggactcctccttggagtctgtctctcatagttgactactccatccaaaatatctctttcatttttcaggtcacaattctccttgcatcccactttatattatacttagctgtaatactctccaattctgattttaatctactttctattttcactaggttgaggctctactccactcactcttggactagaaaatttacgttagtcctgtccagtcacattatggctcagagagtcaccatattttacattgtacatgagtttatttctctatgaaatggaaatctggaaacataatattttatctgttttaaccatgcaactaacctctgtatttacactgagagttcttcaaactctcagaggagagctaaggacataatactctgcattccccaccaccactggactttcatttgtaagtcacaggcacctgggaagtgtaggcctgttgtctgtgtttcctcctcttgcaggggtatgggttttttttgtaattctctctgtggtttttcttcccacaagcccagctagagagtgagacagagcctcttctgcccctcactttctatgaaaatcagcacactaagcttttggtattaagggatttactgccagttgattctgttcacagagcacctagtgtttgagacctttgatttgaagtgggcacggatttgttggatgcttttgggagcaggctgaagagttgggttgagactggtgataggacaagtctacacagtagactagtggtgtgtaaagtgagacccacgaatggctgggtttccagagatcatttacataacatcacattttttcacataaaaatactaaggcatcatttgcctgtgtttttctcttattctttcactatagttttctagagggctcatgtgcgtgatatcaccacagattgaatgcagagcagataagagacttcagcagtgattttctattaaaccattcattagagagatttcaaaaatgttaaataacattgctcttctcactaattttttttattttggcaaatacaggtatttttcctagaaaacgtgttatttatgttaacttgcaatgagttaattagtgttgtttttatagagatttagtaaaatttttaaattattagttttaatttctaatgccataaatttcaatattacccaaataaacccaagctctttggggtcctcaataattttttaaattgtaaatcataccttttaattatatctgctttttcatctaattgtttgttataatataattctcttaataattgaattatgtttgcttacatgtcttccccctcgatggaccataaatttcctgaagaaatagtccatgttgtttcatccatgtgtttacttccctaacagaatctctattacaatgcctgaggcacagttaacacccaataataattattgagtgaacaaataaatgggcaaatatcccccgccttaacttcttgctcgaatgctaagccatcttctatcaagtggatattctccctctgaagttatctgtgactcaacatgtccccatcttctgctctattctccagcttccataacgtgatttagtaacatcatcatgaatcaatcaatatctctgtctctctatcattctgtcctgctcttctctccccatgttctcactcccacatgcagacacacacatgtgtacacatgtcacacacatacatacagatgcacttattcctggaacactcttattttcagttcaagtcccagcccaaagtcacttatccattacaacagcattataattgtaccaacatccatttttattaaattggtgcaaaagtaattgtggtttttgccattatctttaatggcaaaattaattaaagataatggcaaaaaccacaattacttttgcaccaacctaatatattattgctcctgttgaattgtgaatcatttaattgtagagttcttattttactctatttttaaattttttctttagcttttaagttcaggggtgcatgtgcaggtttgttatataggtaaacgtgtgtcatggaggtttgttgtacagattattttattacccacgtattaaggctaatacccccttggttatttttcctgattctctccctcttccctccctccaccttccagaatgttccagtgtctgttgttctcctctatgtgttcatgtgttcttatcatttagctcccacttataagtgagaacatgtggtaattggttttctgttcctgcattagtttgctaaggataatggcctccagctccatctatgttcctgcaaaggacatgatatcattccttttttctggctgcatagtattccatggtgtatatgtaatacattttattaatccagtctatcattgatgggcatttaggttgagtctgtgtctttgctattgggaatagtgctgcaatgaacataggcattcatgtacctttatggttgaacaatttatattcttttgggtatattcccagtaagggaattgctgggttgaatggtagttctgttttaggtgtttgaggaattgctgtactgtcttccacagtgggcaaactaatttacacttccgccaacagtgtatattcattcctttttctccacaacctcgccagcacctgttattttttgacgttttagtaatagccattctgactcgtgtgagatagtatctcattgtggttttaatttgcatttctctaatattcagtgttatttagcttttcttcatatgactgttggccacatgtatgtctctttttgaaaagcgtctgttcatgtcctttggccactttttaatgaggttgttaatttttttcttgtaaatttgtttaagtttcctatattaatagatgctggacctttgtcaaatgcatagtttgcaaaaattttctcccattctgtaggttgtctgtttaccctgttgatagttgttttgtttgtttgttgtgttttgttgctggggagaagctctttagtttaattagatcccagttgtcaattttcgcttttatggcaattgctgttagcatcttcatcatgaaatctttgcccattcctatgtccagaatggtattgcctaggttgtcttccaggatgttcacagttttgggttttacatgtaagtctttaatccatcatgagttaatttgtttaaatggtgtaaagaaggagtccaatttcaatcttttgcatatggctagccagttatcccagtactacttattgagtagggagtcctttccccattgcttgtttgtattgactttgtcaaggatcagagagttgtaagtgtgcagccttatttatgggctctctattctgttccattggtctatatgtctatgtgtctgtttttatacaagtaccatgctgttttgattactgtagccctgtgatatagtttgaattcaggtggcatgatcctccagcttcttctttttgcttaggcttgctttggctatttgagctctttgttggttccatatgatttttttttttttttttgtctagcttttagtgaactatcattggtagtttgataggaatagcattgaatctataaattgctttaggcagtatggccattttaacaatgttttctctctctatccatgagcatgaaatgtttttccatttgtttctgtcatctctgatttatttgggcagtgttttgtagttctcattgcagagatatttcacccccatctgtttagctgtattcctaggtattttttccttttgtggcaattgtaaatgggattgcattcctgatttggctctcagcttgactattcttggtgtataggaatgctagcaggttttgtacattaattttgtatcctgagatgttgctaaagttgtttatcagcttaaagagcttttgggccaagactatggagttttctagatataagatcgtgtcaccagaaaatagggttagtttgacttcctctcttcctatttggatgccctttatttctttctcttgcctgattgctctagccaggacttacaatactatgttgaataggagtagtgagagagggcatccttgtattgtgctggtttttaaggggaatgcttccagcttttgtccattcagtatgatgttggctgtggttttttcatagatggctcttattattttgaagtatgctcctttaatacctagtttattgaaaatttttaacatgaaggggtgttgaatttcgttgaaagccttttttgcatctattgagataatcatgtgattttgtatctttagttctgcttatgtgatgaatcacatttattgatttatgtggaaccaaacttacatcccagggataatgtctatttgagggtggtagatatgctttttgatgtgctgctggattgggtttgcccatgttttgttgagtatttttgcattgatgttaatccaggatattggcgtgacattttcttttttgttgtgtctctgccaagttttggtatcaggatgatgctggcctcatagaatgagttaagaggagtcccttctcccaaattttttgaaatagctttagcaggaattatgccagctcttttttgtacatctggtagaattcaactgtgaatctgtctggtcctgggctttttgttgttgttgttggtaggctgtttattactgatacaattttggagataattttttatctgttcagggattcaatttcttcttggctcagtattggaaagaggtttgtgtccaggaatttattcatttcttctacattttctagtttatgggcatataggtgttcataatattctctgatggttatttgtatttgtggggttagtggtaatattacttttgtcatttctaactgtgtttatttatttggaccttcagtcttttcttctttattaatctatttatttcaccaattaaaaaaataacaactcctggattcattgctcttttgaatggttcagttctccctcagttcaactctgattttggttactgcttgtcttctgctcgatttatggtcaatttattcttggttctctaattcttttagttgtgacactaggttgtcaaattaacatctttctaacttttttatgtggccatttagtgctataaatttccctcttaacactgatttagctgtgtcccagagattgtggtatattgtatctttgtccccataaggttcagagaacttcttgatttctgccttactttcattatttaccaaaaaagtcattcaggaatatgttattcaatttccatgtaattgtatggttttgagcaaatttctttgtcttgatttctaatttgattgtgctctggttcaagagagtggttgctacgattttagttattctgcatttgctgagaagcatttcatatttcattatctggtcaattttagagttatgtgccatgtggcagtgagaagaatgtatattatgttgcatttgagtggagaattctgtagatgtctatcaggtccatttgatccagtgctgagttgaggtgctgaatatctgtgaattttctgcctcaatgatctaatattgtcagtggggtgttgaagtctaccactattattgaatgggagactaagtctctttgaaggtctctaagaacttgctttgtgaatctgggtgatcctgtgttggatgcatatatatatatatatatacacacacacacacacacacacacacacacacacacacacacacacacatatatatgtatatatatttaggagagttagctctgcttgttggattgaaccttttactattatataatgtccttctttatcttttttgatctttgttggtttaaaatctgttttgttggaaatcaggattgcaacccctgctttttttctgttttccatttgcttggaagagttttctccttccctttatttcaagcctatgtgtgtcactgaatgtgagatggttctcttgaagacagtataccaatgggtcttagttctttatccatcttgccactctgttcccattaattgggcatttaggctaaatgcctctttacattcaaggttagtattaatacatgtggatttgatcctgtcatcatgatgttagctgggtactatgcagacctgtttgtgtggttgctttttagtgtcactggtctgtgtacttaagtgtgtttttgtagtggctgatactggtcttttctttgcatatttagtgcttcctttgggaactcttcaaagcaagtctggtggtaacaaattccctcagcatttgcctgtctgcaaaggaacttatttttcctttgcttatgaagcttagtttggccagatatgaaattctgtgttgaatttcttttctttaaaatgttgaatattggcccccaatcatttctgactttagtgtttctgctgagatattcactgttaatctgatgggcttccctttgcaggtgacctgatttttctctctagctgcctttaacattttattaattcttggagaatctgatgattatatgtcttggaaatgatcttgtgaagtctcttactgggattttctgaattttctgaatttaaatgttggtctctctagctaggttagggaagttctcatgaatgatatcttaaaatatgttttccaaggtgcttgtactctccccatctctttcagggacaccaatgaatcatagatttagtcttcttacataatctcatatttctcaaaggttttgtttattcttttttgttctcttttctctattcttgttgactgtcttatttcagaaagccaatcttcaagctctgagattctttcctcagcttggtgtatactgcgattaatacttgtgattggattgtgaaactcttgtagtgtgtttttcagctatatcaggtcagctaccaccttttctatactggctactttgtctgtcagctcctataccattttattgtgattctcaacttcgttggattgggtttcagtgtactccggcatctcaatgatttttgtttcaatccatattctgaattctatttctgtcatttcagccatcttgacctggttcagaacccttgctgaagaggtgatgcagtcatttggaggaaagaaggaagtctggcttttggagttgtcagagtccttgcattggttctttctcatctttgtgggctgatgtttcttcagtcttttaagttgtcacctctggattttttttttactttatcctatttatttcctgaccttgaaggtttgattgttgtataaggattcagccaactggcttcatttctggaagattttagggggccactgctcagctcccaattcctggactgcatgcgctatctctagggttgaggtggggggacttgtatcagccctgacttcgttctcaggctcctcaaagttaggactctattgtgctgggtgggaggtgaggtgatcctggactgctggtactagtcactagactctgatgggtggtgtcagccaaagcatttcatagtgcaatggcagcaggatctgtcgtcatttgcacttgtcagcagcaacagtagctgtagcaaggggttcacactctcagctgtggcaggctgctagcagatgcagaggtgcctgcttccacgcaggtgtccatcacggtagtggaggcaacacagctggttgggggggtgcttgctgttgacagtgcacagtcacactggtagggtggggctctggtgggtgcaggtctgcgtgtattctctgtggccgtaggcaagggtggtcactcagggtacagaagggtttgctgttctctgtgtctagtttcactatcatggcagtgctggtgcaagagcgaggagctggtgggagcagggctggctggctctattactgccaaagttctgacttcaaaggtagtccagtggggggagaaggggtagagggcatgcccactgcagcagtcacagggcagggtgcacgcccacatgtgtgctagcagtgcaaggaaaacaaaacctgcccactcccacaggtgccagcaaagtgatgtggaggtttgctgtgggccccaggaaagctgcagcatggggaagacctgggtaggctggtgtgtggccacgggggctgacccgctggagctctctactggcaggcacagtctgccagtgcaggagctatgatgcaagtccctcgggtaactgagactgccctgcaagaagatgtagccaggctggggcccagtagaccaaggggtgctcaggttggaccagccaggtctgatgggcaagactgccctgcagaattcagggcccgcagttctcttaggactaacgtctcctatgggagcaaattgagcctagggaaatgggcttcccttgttgtgctctgctacagacattcctgcaaactctctgggcttcacttcagctggcatgctgcccctaccacttctctaagcagctctccctgcctactcgagtttccatggtgattgaagattcttctcctgccaggattccagaggagcatgggaacagtgggttgctccttgccagttcaactcacttgttcccccagggtcactgggggccaggaaaaagtcctggtgcatggtagccccaggcagggttcccagcttcctctcccttcggtccagcttctgtatcttccttctgtccactctttgtgccttccctctgaagatctgtcagaagtgtgccaattgtctcagtcccttagtggcagctgttccaactggctgtgtctagttggctatcttggcgtctctcctcaataaattttaagaatgtaaaaggctgtaagaacaagaccatgattatattacataatgagaatgagaaagcagaaaaaaaaaaaaaaaagaacaacaccatgagaactgctgctgtagaccactgggttaatgtcacttaaaagagaggaaacagggaaaaagcgtcaaaaattaagcttacagtcaaacaaaatattgatgtaagaaagtcagccacaaagaagattagagtcaaaagtcagcaatcaaagatagattgagctagtagaaaatcaaacttcacctttcctgaaaatggaaccatctagactcagggaccttgccatatagtgtattagccagagttctctagagagacacaaccagtaggaaggatagatagatagatagatagatagatagatagatagatagataggggatttattaggggaactgactcacatgattatggagactgtgcagtcccactataggccacatgcaagcatcagaatcagggatactggtagtgtggcttggtccaagcccgaaagcctcagaactaggggagctgataatgtaactcttagtttgagtccaaaggccaaagaacctggaagcctgctagtgcaagtcctgaatccaaagctcatcataactcttgaagaacctggagttatgatgcccaagggcaagagaagaagggaggcccaactctacaagagagagagacagagaacttgccttcctctgcctttttgttctctctgggcccccagccatttgcatcatgcttgcccacattgagggcagacctgccctacccagcccactgactcacatgccaatctcctctggaaacacccttacagaaataatactttaccagttatctatgtatcgttaatccagtcaagttgacaccaaaaattaagcaccacacttggaataactgtggtctcattggcaaatggataggaagctatgaagttctgtggaacaagctctataattacaaatattaaatatctatatcctagagaagcctacagttttgtggaggaatgctacatttatttctatgaaaggtttacagtcatgaattaaagtgagaccacttagtttctttgtgtgattttttttttctcccaacaacattccaacacttgagcataagcaagtagagggtgggattgaggtgtttctggcatgcagagggaaacaatggaattggagacattgataagtgagaaattataatgatgagacattattttggggttgagttaaaagggaagtgcaggtagcagatgatggattggatagttaaaaaaaaaaaaaacttgaaagataaaaacaaacaagcatcccagtgagttagacttcttgaaggaggtaagaattgttggagtctgggtactagaatgaatgaattagaaatatacgagcaagcgattagaaagtgggatgcgtaaaatagagattttagagcatgcttgtccaacccatggcccagtgggttgtccaacccgcagcccaggctggcttcaagtgtggcccaacacaaatttgtaaacttttcttaaaacattacgagattttgtgggtcatttttttttagctcatcagctattgttactgttaatgtattttatgtgtggcccaagataattcttcttcttccaatgtggcccatagaaaccaaaagattgaacgccactgttttagaggttgtgcaggtattgattgcagcaagataatggtccctgggtttcttcctgttgctacatggtgagtatcttcagagcaatggaaattaacacaatatgaagatagagaatgtctcctctcccctaatttgtcatgttttttgatagcaaaatctaaacttagctttctaatcttccccagaacaaattgcttacattccagggtaaaaggacttcccatctttccccaaaagaggatgtgtttacattccagagtaaaagatagtcatgtcaatctctctccctctctctgaggatatgccagcagttccaacataagctctgggttttgataatttcagagttcctctcctatgatgctaaccccatcaggtacatgtaactcttgtcatgtctctccatgaggaactggggcatggagaaaaggtattctgtgagtaaacaaaagctttgttccctgatccagaggtttcatgtttctgtttgtgtgtgcatgcacgcacacacacacagacaggtagttttttagcttgtaggtggggtaacatcttagactcttcacacttccaggtttaagactgatgatcacaagattcgtggaatgaaaagctgagtgtagtagagcaaaatactgaagatgaagatgaactgagagtcctgactgctagacaggttatccataatgatgtaacatcattggttgcagaagcagggttacagagaacgaccttgtgccagaagctgaactcttcaacaaatgaaagcactgagaggaatactgacttatgaaagctagatggccatataaacagagggcaaaagcttccaaaagcagatgttttggttcacatcattttctcctccaagagaatatgtggtccagaaagtcaagaatgccaatatattcgtctttgttcccacagcactaagactatcaggatgagggtggggagaggaaaggaaaagagaaaaggaagacacatagtggtgtagctagtaaagatgctacctgtgtggctgtcaatgtgagaatcagggaggagagggtcaatggataacttttcactttaatgacataaaataaattagacttgcatatttgttatttaaaagccagaaagatggaactaaaacattttatgtttcctttattcttagataccatttcattttattaaaacatttacaaaataattaaattttgacatgacagtaatattacatacatacaaatctgacttctagaatagcatgaaaaactcaaggaataagaatgcttgaaataacttgtttatgttgtttatgttgctatgtgtattcaacagtaattgagcttgttcctttcatgtttcactgctctgcgaactgaggatgtttccttgctaaagaaaacacaggagaagagggactttttgagttggaaacccaaggtttataaaaataaatttgaaaatgaaattataaatttccaataaatgtacatgttcttgaatagatgttccagattgggggtcatgatatagacaaaaagttatttttatgaaaatcattagaatgagaaatccattgtaaaaataaaatttccctggaaactgaaaatttaggaagctataaataaagctaacctttgcatattttgcaactctagatctttgctttctacagcttctcagagctccagtcactgggcttaccccattcaattcccaaaaaatctttcctcgaggaaagagggtgtctcacattcctactttgccttccccaggattattcttttctgctctttgagcttctccaacagattttctggacccattcctcaccaacttgttcactggtcacagggctgagtttctaacttcatccacattctaaggtcataacccagtagactggctagatttctcagtcttccctgaagactaagtttactctcaagggcgaaagtgctaattcagttagggccctcttccccataagcacatcttccaggtaatacatgtttcatttccttttagccatttggctcccacagttggcacactctgctacttttgtttgattcaactgatgccaattacctgctgaattagggagatttccaagccctccctgacatatgctgctcactgttcaccccctcaaatctcagttcgtgttagtcttcacatgctttgatcctttcccgcctatccctgtctccttgaaggaacactgccttgattcaatgacgaatgatatgtatgctatgctagtgaagtctgaatcttcaggaaactatatttaatattagtttctgtaaaataagcatttaaaataaattgaagaaaaatatttagcacgtcagattattttaattgctagttatataaatctgattatactagcttaagcaaaacagtaatttgttggcttatagggttaagagtctataaaggggtttagctttaggtgtattgtgattcaggagctcaaatagcatcatcagattctggattccttggatatggataaatcttgttttcattcttcacagaaggatttttttttctttcatgtaaggcaagatcattcttttcaacatggattaatgtcctcctaattcagaaatcatatttttaaaaagcctctctctgatggtatctaaatatctgttagtctttcctggaacctctgaccctgtttgtagcaatctctgtgttcaagaaataaggagctcttattaacaaggtctgtgactcttcatggtatgaggagaggtcaggacactctggtaggacaaatgaactcatgcatccatactgaagtgaaagaggaggatcacaaacaaaaaagcaggacacaatttccataataggagggaagggatgctaggcaagaatcagctcaccactgtgagacatggttaagccctgtccttagtctatgcttctcaaagtcacatgaaagtcaactaactgagccaatttggccagagcagttctggttttagcactgataattctgtatcttagaaaactctgaagttctaggcaaaccattctggtgagtcaccctaggtatatattcaagactccaaaaattaacaagaagcatcttcgggacacatcaaatttgctaaataataagcatttttattgaaaatgtattttgtattaaacttatggatatattttatggtgtagaatgtgaaattctcatgaatttctattataaagttgaaacttccacaatatacactctggtttcaaagctgctttagctattaaaaaccacttggatgccattttaaaaaatgattgcattaaagcatttgtgcctgtagacacaggtacacaaagatttgcaggaatataatatttacaatgatgcaaaatgacataagaagttttaattcagtttattaatagaaaagaaaactagacaaatgatacaaagatagtgatattcatttgtaaacagaattaaaaggaaataattggacatgtagtaatcatttacaaatcattataacgtataatttcagctggatgcagtggctcataactgtagtcccaacactttgggaggctgaggcaggtggattgcttgaggtcaggagtttgagaccagcctgacctacatggtgaaaccccatatctactaaaaatacaaaaattagccgggagtgatggcaggcacctgcaatcccagctacgtgggaggctgaggcaggagagttgcttgaacctgggtgcggagtttgcagtgagccacaatcgagctactgcactccagcctggatgacaaagcgagactctgtctcaaaaaaaaaaatgtataatttcaactggaaaaaagatgcatcaaaggaagatggagatcactctaggactatttgttggaaacgtagatattggtttttaaaaacaggattatttccttgctaccctcatggaccctgaccatatcatgccctaaattatggtcataatttagccatgttattacctgggtttggaatactcttgtacccttgcctgtttgatgaattcctaacaatttttccaaccacagcttgaatagacttctctctgtgacgatatccctgactcccctagtccccctccatttctgaaactctgcaaactcactctattataacacttatcacattttattagagttgtttttcagggtttccattagactgtgacattcttaaacccagaaaattagcctttctgagattattatcccagaaccaagcataggcctatatcacagagtcactcatcgaaagaggttcgtgaaatgaagaatgaaagaatgaatatgacagtatgaagtcagtacagattagaaacaatgtattttgcttgacatatttaaaataagcaagaggttactctggagtttttttccactatatttttcattattattatataattttacaaagccaggttttccagctcttttactttaaagtttctaccgattattgtgggagaacatgaataccttcctatatcagttccttgagatggttttcagaataatcaatacaggaaatagattttcttttatttggtgtaatccaaaaaaatagctggtgactaaagagatagtcactcctgacaatggctacagctattgcagaacagcaatgctaatgtgttaaccagtcatctcgaagcacatcacagagaactgaaacgttttctactagccccttcttaaagggtctacctcatatccttctgattttgcccctattttgccagtcaacaaagggaatagaagtttctgttgcatctcctttttatattctataacgtagaccaaccttccccacaaaaaaggaatgagttttgaatattactattcatttcaaatttcttaaggccaaaacaatctcatcaatctttttgttcttccaaatatgagataagactaaactctgtgatacttgagaagttttctaaagttggatgaaaagccaaatggcagtagttatcatctccgataccttacaaagccaaaggcacgtcagtcttaatgttgcaaaaggagagtcataaaactacaaaggatgagaacggtggtctaacggaacaaagaaaactgtataaataccagcacaaccatcaaggtgttggtgatgaaatcgaataaagagaagaccagattcctgagcttttacttttgtgtttacttttgtactcaacaatatactggtactcagtacagcttgcctgcaactctgcacacttggcatgaagaaatggctttcctgagaggttccaagaggggacaggcctacctatggtcttgcgtagtctcattggaactattaaatatactcttctcagctatcacttggcttttacttttttccttttctcattctctggcttcagcctccaataatgttggttgctgctggagccaccagcaatgctacagtaagataacccactgatgtttctctccttagtagcacctaaggccgaagctacatcgtgccaaagcctggctgagattaattggcctctttgtgcaaaagcaatcatgctgagctgaaggatgttaacactatgagtgtgttaatgtcctccatatggattgctgtcttgcgttctcaccagaaatgaggatattgctttgctctatgtagtatacggattgcaaagcaggcagggcccacaagttttacagggctattaattagccatatcataggttttacttgtttttctctcttctttgaattctatttccatgagtgcaacagacactcaaattacttccaaatcccgtaattatagtcatttctcctgattaacaaacaactttacaattaggccaaggctgtgggcttgaactttccttcctcagaatgtttctcaagaagttcttcctgcagtgggccagttttctaaaagtccatttatttctgaatccaagtataagtaagatgtaatgtaccactttgtagatgagaagacgtcatttagaaagcttgctaacttatccaagatcacagagatgtatggctgtaaaaccacacagccataaaacttccccttttcacttttgctttgatattcacaggatgtgcatgtagctaagagaataaccttcagaaatacatcagaagtgctaagcagtggccttatgtttcattttattgtgaaaagacgttggtaatagtcacgtgacaagtggcggggaaaagatgtccaaagtcaatgacttaaggaaatggtcactcctgacaatggctggaatagtcacatggcaacggtgctatgacatcaacccattctgtcaaagcatcacgtaaaaactgaaacagaggtccagtttgtaggaatgagaagggtgggggtggggggaataaaagaaaagagccaatactgctttacaaaatatacaatgtgaagtacaactctattgggattgtgagagaagaggccttccaatttggaaaaatgttccttttttctccttaacagtttagatcagggtttgcaaacctaaatatctacagttgtcaagcaactattgtcaacaggctaaggtagtagaatgtaaaaagcaagagagaagctgggcgcagtgcttcacgcctgtaatcccagcattttgggaggccgaggcaggtggattgcctgagctcaggagtttgagaccacccagagcaacatggtgaaaccccgtcactactaaaagtacaaaataaaataaaataagataagataaaataaaataaccaggtgtgatggtgcgcacctgtagccccagctacttggaaggctgaggcaggagagttgcttgagccccagaggcaaaagttgcagtgagctgagactgtgccactgcactccagcttgggccacagagtgagactctgtctcataagaaaaaaaaaatgaagaaagaaagagagaaacagtgactgtcaaagaggatcatctgccgcatctagagagtcaatgactactcacctctagctaattacttgcattgggataaggtcccatatttccagggctcctggttagtatggaaaagctggaataatgaagttttatggtgaaatctcctgatttttaaatgttggctccttgtgaaacagattgtgtaggctttaagccaaacataacataaatgttgttcagaaatggcctgaccagtttgcaagctctatttacattctgctgactctgctaattgtcctccattgttagaggtatgcacatatcttccaaatacgcagatgtatgttgtaagtccatgttaatttctcagttatccatttgataatatgaggaaaagagtatgcctgcaagtggctgtactgggaaacattagagagatcagacccgattgcttatttctggctgacatcattatagaacacttagaatgccagaagtccactctaacacactgactgccattccagcctctccttttactctttcttcccacctctgcacttgtacccaaaagaagtggtattttagaatggtatttctaatttaaggcaacaggaggatggatgaaaataacctttgtgcataaggggtagactctctggatagtgggtggagagtctaatggcagaatttggaaagaagcaattttatgaagtagctattactaaggaaacagtatcaaagttaggtaaccatcaagcaaatccccaaccttctaaaacttttaagttcatgggtggtttgccttgggatgataactgaaagcatattaaatatgcagttcaaagttgcttccctcctaccttatagatcctttgtttcaccaatccttcagaaagtttgatgttcccttcagcattgaatggtgcaggtgtaaagtataaagggtcaaaaaagctatgactgcttcatattcaatctcccactactactttcagagaaggagcaatgttccaccagggagaccatgcccatacattctaggcggtggcctcagtagaatggcaagtaatggtaggagaatttctggggagacagtccagcagagacataagtccaagccactggtttacaaacaggtgcagcaccaggcaaggtgatctctggaagagaggaagactaatgcttttgtttcattggtttgtctcctaatagcgaggtggaatcatagctgtcataatcactacagcatttgggatttggaaaagcaacaggttgtaactgtgggtatgaatggagctttatgagtgagcaaatggatcaaatcaaggggctccgaatcaagcctggcctgacagaacttgcatttccttcacagccaccaacagaagagaaatcaacttctacatttactctaaggatgaaatagtgtcatctagtggcagttgaaatttgtttgttacttcaaaatcattggataagttaggattgtaatgctaagaagtctatacactatttcagataatatcagaaaccttatttttaaacttctatttttatatcataacgaagcaagtaattatcccaatattttatattaaggttattatctttcccattatatagagaacatcacattatagtcctctctgctccctgcctctctccaacaacaacaacaacaacaaactctcagctaggtaccactataaatttgacaatagagattttagggccaggtgcagtacctgatatctgtaatcccagctcaggaggctgaggtgggagaaccgctagtagacaagagttccagaccagcctgggcagcatagcaagatcctgtctctaacaaaagaaaaaaacagccagatgtggtattgtgtgcctgtagtcctcgctactcgagagactgaggcaggaggatcctttgagcctaggtgattgaagctacagtgagctatgactgcatcactgcactccaacctgggtgacagagcaagaacctgtctctaaaatcctctttttttttttttttgagatggagtgttgctgtcacccaggctggagtgcagtgatgcaatctcactgcaagctccagctccagagttcaagcgattctcctgcctcagcctcccgagtagctggaattacaggcacctgccaccatgcccggctaactttttgtatttttagtagagacgaggtttcaccatgttggccaggatggtctcgaactcctgacctcgttatctgccttcctcagcctcccaaagtgctgggattacaggtgtgagccacagtgccagccagccctaaaatcctcttttaatatcttgataactatgagactgtaagatgattgtagtttattatcatgccaatgtgctattttaagccaagccttgaaaaccatgtcagtctccttataccctaagattatctttttatttccctacatgtagtaaacctatatgtgatgttggttaaaaatcaagtcaattaaatctaaagtctacatatttgccgactcaatgagtatgctctatattcagagctagctacccaaacatcgccaacataacgtgttgaaaagacatggaattctatgcactgactatggcgcacccttctgctgtgtgattctagccctgtacatgatctttagctgttttgcctttttaaaattgtagatctgatagataacataaaatttttcctgtgtggtaaagacttaactgacttatccccttctcccaaaacagtttttgccttcatttgaaattcatttaaatattcatttatggccaggagcggtggctcacgcctgtaatcgcagcactttgggaggccgaggcaggcggatcatgaggtcaggagatcgagaccatcgtggctaacacggtgaaaccccctctccattcaaaatacaaaaaaaattggcggggcgtggtggcgggtgcctgtagtcccacctacacgggaggcggaggcaggagaatcccttgaacccgagaggcggaggttgcagtgagccaagattgcgccactgcactgcggcctgggcgacagagtgagactccatctcaataaataaataaataaataaataaataaataaataaataaatacaaatattcatttacatgacatacagatttgtgaggtttggaattttcatttgaactgcttataacatctgcttgattccctcatatatgtgtaaaatgcttctaactggggaaatgacatattgattgaaaaagaaatctctcaaaatttaaccatgttttcatgaactggagagacaagtccctttatgtaactaaaacggccatactaaaatgctctagcaatgaaagagttagagaatacttataaattaatccctaaggatctttcctcatgatctccctctatatttcaactttaaaataaattattatttaatgtagaggtttgaaaacctaaatataatcatctccttagcattaatttatcaaacagaaggttaacatttttaacattcatttaacaaagcaatttatctgagtggcaaatattagacatttattgaattacttgcttatttacttaggtactgaggccacactgtccttttgagaatttttttttacatttcaatattaatttctccagaagcaaatttgggtgagctgctttcttatttctctttcattcccctaagaaaaacaaaagtaaaatatagtggtggggtcaggatggcataggtacagggtaatgtggaaggtcacatgtaagaaaatataacataattttattaatttaacctgttctgctccttgaaaaaattctaggttataaaatccattgcttgccatccagaaaaacaccatgcaacacttactgcttcaatatttcataaaatatatatttaggggtttttctttttttttttttttctttttggcaagatggctatgaattgggaatacaataacacaaaggaaatcctctgagatttacaactgcttctaaaaagctatgaaaatttgctcactctttgaacaggattttatgaaggctaggtttttacctatcattgtttatgatcttacactttttaaaacaggtgaaaactacccttcaacctggtgtcactaaaagattaaaagtttggatgaagaattagtgctggcaagcatccttaaaacaaagaaataaaaaccagtgtcttggggcacaaagtcttctgaaatatcttcagcaaattgcttcatgtgggactcccgttcatagcaacatattgccttgtttcatagcaaaatggcctaagtcatattttctagaaccagatatctgaactttgctttatttttagtttggcttagtcttttgcatggtttcagtctattgtatgtacttcttccattctatttataaggctttgagaaattttatttaaatgcacagacagtagtatatacatacacacacatatatgaatcgaatgcccataatggagagttttagatttagggagtcagaatgtctatctcaaataaatgttgtatgttccttataccaaaaaatatttccatatgggatatacatgctaaaaataaattattatttaatatcagtctgataaaattcatgatataagctcaggtggctgtccaaataaacaagagtaattaattttgccattatttctattaactcccaatatttaatactaatatatgttcaaatagcgtttttcatgtttttaaaaaaagtagtttcataattttttttcagtctgatgcactaattgtatactattgggatatttgaatactaactggggaaaattagttctttgtgaaggtcaaaaaataactattgagataaaatttgtatacagtgaagtgtggttttggcataaatgtgatgatggtggattcaaatcacagcagctgagaccatctatgctttatgatccccacagctggaaatgagtagtacattccgaaggtcatgacagagagactggggtgggggcagagagagagagtagatgaatacatagacagatggctttgaaacaccaagattcataagcattcctgtgtcacacttttagataaattcagatgctttcttatgatgtggtagtaaccgtttaacaacctgctctctaaaaaaaacaatgtatgcgtatatgtatgtaaacaaatttattataaattttaatgatataaaatatgtcccacacaatttatgtatgataatataatacattatcttctttattttatattccatatagcaaagtgattttcacagaatactttcattaatatttgccaaactcttgtatttgtattgaaattatggttgcaattgacattaatgttgatttttttatgttaatgagtaagacaacaaagaaacaatgaaggcatatatagaaacttcactcattcaccattggcctaaacaacttattagcaggattgaataacagtttttgaatattaaaagaataattcctcagtttttgtgcgatttctaatgtaacagtaatagacacaacaaactttaaagttaaattgcattattaatagtttctccatcattttcttaagtttataccagagactgccgaactattatagccttaagttgaatacagcttgcctcctgtttttgtaaataaagtttttttggaacacagccacatccattcatttatgtattggctatgacagctttcacactgtcataacaaatttgagtagttgtgacagagaccatatagctctaaagtccaaaatattgagtatctggctcctaacagaaaaagttttctgactcctgaagtaaaccagcatttaccaataaaactttctggtataatgaaaatgttctttacctgctctgtttgatacagtaaccacttagctacatgagactattgagtacttgaactattaagtactatcattgaagagctgaatttttaatgttatttcattttaattactttaaatttaaatagccatgttttgctagtagctactttatgaagcagggtaggtcgagacagttaacaacacgacgaatcataccctgatttctcacatttgctgaatttcaaggtgtaaatatggagtcctaataagggaaaaggagtcaggctggtgggaccaagggaaaggaaagagaaagcagataagttataagcctacctttcttcatgattcaggactcatagccctcctgcacaaacaactcacaacctttctgtgcccagctatcactagaccctcagctgctggaaaaatgcaagttagctcactgcaaccttgatattacaaatactgcacaaagcccttctcagtacacagcacaagcaccattgtataaaatccccagcaaattttgactccttgaagtcagctcctctattgctggtctgcccattgcacgtttgcgaagtattttcataccttctccaataaatctgcctttttatctacaactgtcttggtaacttcttcttaccctaatgccactggcctagatagtcattgattacccatgatagtaaatacatccactatggccaatttcaagctatcaatgtgacatcactgaacaagttaggaagaaatgtacattattatacagtatttgtaccatacagttacaataaacataaataacctcaaaagcatagataaaacactagtaaataattaagaagtgatacattttgagtatttattacttcgatttttaatttaattaatttaattatacatttatataatttaattttaagaatagatgtgtttaataatgaatagcaaaattcctaaaaaatgttaacagttttctctcaaaccagtgcagtctggcttcagcagatgactgagtgaaaacaccatgctttttattactatacataaaatcaattgaactaaaaaaaaggtaagtgaaagagaaaatcaaaagggtgcattagtctgaaactcagtttgtgaaaatggatatactgtcaaaggcaaggcatttttagttgtacaaagagaacagtgtcacagaaactaacagagtagggattttttacagagtcagtggattctaagggaatttcaaagaggatccctctcaattaatatgcaaaatttatgtaaagatataaaaacattttcccgggaataaattaacattcagggaggttggggaattttgtttttgaaaatttgaatattaaagttgttgagtctcagtcacaaattcaataagcacatttgtggcttaaatataatgagtgtaaagctaaaaccataaatctttggatcccaaatctgaaataggtaagagtagatgagaattagcctaagctgaaaaatggaacctaaatgtctcatatgaggctaggcaggagccaagatcatcactttgaaactatttgaagaaaaaaaattcataaattgaaatatggtactgagagtcatacagaattcagcacaaagggacaaagagattaaaactatgaaaagacaagtgataaatacatttatgggtagaattaacaactctcatataggttcaattaaaattttagaagtgaaaaatagaataaatattcaaataatgatggagaatttttacaactgaagatctggactgatatttgcaatgggtatatctaacacataaacaccctgaatattttaaaacctaaaaaatcaatatggaaaagttaaatatagaaaaaaaaggtagtgaacaatttataaacttaaaaagatgtgtcattccaacaatttcagaaagcacaaatttaaatcatgtagagatattactatacattcattagattgaaaaaagtataaaactctgatgttgatgatatggagcaggaaaagagtttcactactttttgcaatagagaaaagttcacacacttatatgttcatcaataggtaaataatgatgatgctatattttatattcctaatataagatatatatcatataaatatatatacttatatgtaccaatattataaaattttaaaataaatgacagaaaataaagcaaatttagaaagtatatttatctgttagattagctacatctggttaaaatgagagagtaatcaaatgacaagagaaaaaaggagaacttcactacctataattttttttttttttttttttgagacagagttttgctctgtcgcccagagtggagtgcagtggcacaatctcggctccctgcaacctccacctcccgggttcaaatgattctcctgcatcagcttcccgagtagctgggactacaggagctcaccaccacgcccagctaatttttttgtatttttagtagagacggggtttcaccatgttggccaggatggtctcaatctcttgacctcgtgatcagcccaccttggcctcccaaattgctgggattacaggtgtgagccaccacatccagccaattttttttttcaaagacaacgcaaatatgacaaaaacaaaatttattaactatagatatttattgcattattgtatgtactttcctgtttaaatattttacaatttaaaaacaattttaagaattctctcaatattgatcctctgggcacagtggctcatgcctgtaatcccaacactttcagaggctgaggcgggcagattgcttgaggtcaggatttcgagaccagcctggccagcatagtgaaaccctgtctctactaaaaatacaaaaaattagctggacgtggtggcacatgcctgtaatcctagctactcaggaggctaagacaggagaatcacttgaaccctggaggcagaggttgtgatgagccaagaacatgccactacactctagcctgggcaacagagtgacactctgtctcaaaataataataataataataaataaagaattctatcaatattgatctagagaaaaaatatcaaattttctgcaattattaaaaaaataaaagaattctatcaatattgatctagagaaaaaatctcaattttctgcaaaaattattggttaatttaagccatttttatacctcaagaagaccaaagagtaataacctctaatatatttcttaatagaaataataatattttgatatatttaaatatatctaccttaatcatcaatattgtggcaatagattatatatctatttaaaactatttcaatttttaagtgtttttacataaagtacatttttaagtatttagttcactatttactgcacattagtttaagtttttttttctgttatacttgtttctgctctcttaccatttttacattaaaaaaaagtgtgagagggcttttcaattaggtgaatctaaagtctttttggctaaatttttctaaaattttagtttaagaagtttttttcttgttgatttctcatccagaatacatattaaaagggcatttgccacattaaattgcattgaacttccttttcaaagccattgtactcatagaacatgtctatctatccttgaagatgaatttgactggagtcatttggcttccctaatcgctctgcttttaaatttaatcatgaagaactccgggtactcagtgctaagaactaatgattgccctgaaaatgtcagtcagcctaagtgactgacaattttttctttgtgaggtgagtatatgacattaaatactggttgaataaaagaataaaaaatcagagtaaagagatctttgttttataaattaggtatattgttcctctagatctaatctaactatagttgtgattatttaaatctgttcaaaaggaatgaactaaattctggtaaaggaataagagtcctgaactgggagaccgggatcactctatcaaaatctgctgctaatatgactggagatttaaacaccttcatctttaaattatgagtgcacaactagataatttcagttgtctcattcaattttatgtttctttctttttcctttttcttttttttcttttttttttttgagacggagtctcactcttgtcacccaggctaaagtgcagtggcgcaatctccgccttctgggttcacgccattctcctgcctcagcctgccgaggacctggaagtacaggtgcccgccaccacgcccagctcatcttgtattttagtaggaacggggtttcaccaccacgctgccgtcaaactcctgacttcaggtgatccgcccacctcggccttccaaagtgctgggattacgggagtgaaacaccgcgcccggccggttttttgtttcttaactggagagctggagccattatgagcaaaataaacataaaagattttttccgtccaaccgatggactaagctagacgttgtatcttcagcattttctcttcatgtacaccattgactattcagcactatacctagcaaatatcagtcataaatgaaaactatagtctgttttcacagaaatgtttcttgtgattttccctcttcgctattcttattttcattgtcttaactcaggtcatcagcatcttttcccatgaactactgaatttttctcctaacagaccatgttcttcatcttcctgcatcccatgtatctccaatgtttccaaggtgtctttcttgatgaaaaagcactgattttataaacttcaatctcttcctttggtttagaggttaaagcctaacccatatatagaattctgcatctttcccaatcaagttttcttatttttctagtacagtcttttgccaatttccatcttccttcttatctttggattcacatccccaactccggagaaggcaaaaacatcaaatttatttacatcaatcgtttattttttcccactttatgcttttggcaatgctgctcctgctgcatagtatacactttcccctttttatcaggtgaaattctacctatttataagtccctgctcaaatactaatcatattgaaagcttctctgaataccttggaagaaaaagttctgcctccctcatctgaaatcatctcatagcacttttatgtaaccctattttagtacttaacacattgagttatatttagttattgcccttatactttctctggtagattatgtgctaatttctttctttctttatccatctatccatcaagaattaattgaagacctgctattcatcagatactttgttagaatataggggacggagttgtaagaactgattttagctttaacaagtttattctttatatggaaatccaacatttaagttaattttaatttacaatatagaatattgagtgctgtggtaggtactcgtctctgcagagaatattttggaaaaaaggagcattaaaatctactgcataggaaggtaagaattaggcccagggactttctctggttgaggtcgaccattcatttattaactatttagagtggagtataattaattctcgatagatgtcattaaatacactttgtttcgagtacgtcgaggcttattctctctagtgtgttggataaaggccacaggtagtgaagatatttcagagatgtgaagaatccagtaggaatgacaacatccagcacttccattcaaccagatcccacagggaaaatgtcagttttgtgaaggcagatacattaaccacatacaactcgattaatataaacaaataatcttatccattgagctctcccacagaccttcttgggcccaatcagacaataatgaagtgcaggcgagacagcattctgcactcacattccaggcactggttcaagtccctcctccaggtccctcaagaaagagacaggatgactgacttactgtatatttgactcattttcctagaaagtgcagactcgctataaaatgtgttaggtggtgagaacgctgatggttcaccgttttcctccactttcagcctcagtgcaaaccctctgcccaaagcctcgctccagtacggaggagctgcgccttcaacacactttctctgttgccaggtaaccacttctccctcagcctagtctccaagggtcacgagccacttccgcctccccctctcgggcgctccaatcagcgacctgtgtagctgtcacgtgggcctctggggcagaccctggagatcgggctcgcggcgccttccatcgtggctccgcgctggggcttgcggagcacgcttcccgcccctcggagcccgcgggcccggccgccccgcccccgggcgccctgagcgagcaggcggggagggcggggagggtccgcgcgttggtggtgctcgcctcgcagctgcgcccgccggcttcagcaccttccgctgtccgccgctgcagccgcctcctcctccaggtaagaagccggtggggccgcagagataccaaggcaagctcaggattgatgtgggtgatgctggaactgtcgcggcgtcatgcgagaggggctctgacctccctgtgatcgcggaccagggtaatgtacgtcctgcagggctttgcacaccatggtgcctgatgagataatcaactgagttttagagccacacacctgattcttacaaggcacagcaagcagcgaatatttatgtatctaaactaccattgcagtgtaaactgtggacatttcgagggacattgttttatttttatggctattaagtatatgtctagagcctaggttgctgttctcatccctccgccggccagacacttctgtatagatcatttacccctttgaagatggacttattagtagggttgtactaagaaaggtttgagtaaaaaggaaatgcgttccagaaaaaagacggtattggatataaggcaggtatactatttattaagtagatcgtaaaatagaatctttgctgtcctcccctctccaaaatcagacttgttttgcttgcaaagattgaaaggaacaaacaatttaaggagactttttaaatatattaattaaaagcaattgattcgaatgaaaagtaatgaaaagtccgaccatgcatcaaaaataaattattttgcatattaatatatacatatatactatatatatttaacaagggtttgaagagagatactacatttctgaatctttcataaataccctttagagaaaactatcaaaaaaacacaagttcgttgtaaaaggatacgaaacggccaaagcccaacaatgtgagattatagttgccgttcttagcactctaataacatttctgcgttgtaaaaattagaaaataaatgacaatgaatttatgagaatttataaatttgaactccacaagagtttaagcattaatttatttgtagatttatgccttatcattaccctgcttgccaggagctgatgctgggcgggtggtgaaacaaactctgtggagaaagcactcttacatccttttgagattctgcctcactggcctaagtgttcaagaaaatggatatagttatatctaactgttttgaaggcagacgtctgagataggtggtctgagaacctttcccctcctatcatctaaaattaaatatagttattaagtgcttttgaaaagttgtcaattcgttaatattttgggaaacatcctttactggattgtttggagattaatgttacaaatggtagctttagagttcctgggaagttttaaagcaatgacttatttcaaagggcatatacggaaagtaaagctcttgagttctgcaaacgtaattatgtaaaaataactagttgaatgttattgtttacattgttctgactttctcttgtgttgatattaatagaactgcttaaaaaactgtggacatctgaagaagacgttaaatatgcttacttgaaagttttaacattctttattcttcttatttctaatgataaatagtggtgttctaaatatttttaagttacccattagtcacataaataattccatagattagaaagccataaattaatttaggccagaaaaacaatgctcccagtagaggggagactagggctagattgcttttgttgttgctgttttctacagactctatcttgtatcctttagtctgggaaaggagggacagggccagtggcagttttttaattacttggagaagtttaagaacaggtttctgtttgtttgttttatggttttaccctgatggatactagaagtccaacatgaatgattaggttgtcactattaatgaaatgtgtaaattctccagagtacctgattttgttgcctaaatactttaatgacgactaaaatgtaattctgacagttttgaaggattcacattttcatcctatattccagaatttctttgaaatctaacatatgcaagaaaggtaacgctttatcagattactgaattgtaatactgaatacttaagagtttacccagctattcatgataattatgtatatggaagcatcattgctacttttgaccactgctgaattatctcattttacattttgtatacctcttccattgaacagatggaaatattaaagtgaagtcatgtatcttccagtacgtcttcaggaacagagatttcatcgaaattatattaatttatagaaatcatatgaggataggctgcgtgcggtggctcatacctgtaatcccggcactttgggaggctgaggcaggcggatcacctgaggtgaggagtttgagaccagtctggccaacatggtgaaaccccatgtgtactaataatacaaaaattagctgggcgtggtggtgcacgtctgtaatcccagctacttgggaggctgaggcatgagaatctcttgaacccaggaggcccggaggttgcagtgagccaagattgcgccactgcatgccagcctgggcgacagagcaagacaacgtcaaaaaaattaaagaaaagaaaaagaaaaaaaggaggatattggaagggattttttattaattcatgctccttttcttttgtatcagaaacatatgaaacttaagatttggttggtactttttgatacccaagactgtgctttatcctgttaaaatagtatcgtgattattctttcattgttgataaaactattccttgaaatttgtgagcaagaaattagatacggatacctgaagagaattttagaaattctcccaaagaatctactctataaggaaacaaaacctagagaaaaacatttttcttatttgagtttacttaaaatgttcacgaaggacttgcaactttggtaataaaaattggtagaaataatataaaatgatcagctttgtatagtaaaagaaaaattcccatcacgattaattagaaagatttgaaaagtttccatgcttaaagcatgggctgtcacattagaaggcagagttcaggttgttttcatctgatttcagtgactagacaggtataatttcagtgactagtcaaacatttcaaataggctagattttgtaagaaaaaaaaagaacttgatattggagccacagctggcacctgccttccagatgtcacattatcagctacttgaggaaaataatttatatatatatattgataaaagtcttactttttattatgttaaatgtacttacaaagtattgttcagtaagctgtcttataaaattctgtaattctacattctaatttaaaaaatgtactgtagaaatagacagtaatataaatctataattaagataatacaggaggtaatttaacaatgttatttgctatgataaggatgattgataattgtcatgttcggataaattgtagcaaaagtgtaagaaataaatttccatgtgtcagtgaagatgttataacagtcaatacttgttttgtacattcaaatgttctgagatggagaactcaagattgaggtccttaaacaatttttcttatgcttaggtttattgttttcttcttccagattcttcccattttttttagttgtaagcatgtaccagtgtcccaggcagactcatttacaatgatgtgtagtaagttcaatttcatatcacgcacacagaaaacttactttcaaatcggaaagtagaaaataatttttattacacaaagcactcgtgtttaacatgctattaaaaaaacccttcattacaatacaaacagctccacatggagtctcaaaaaaatgaatagttggttaataagaaatagctaacatttaattaagtttgattctttaagataaaacattatggatgacttttaatgaaaagagttatgcaacattttatttttaaggtaaacaggtttgaaggggtcattttggaatttatgatagaaggatccttaagaccagttactctaacaccgttattctgttaatgaggacactaaacacataaaaattatgttctcaaaattaataagggaaaagctggcttatgttctacttctgaagctttacttgggagtaccatgaactactaaataaatgaatttattcctgaaaatataatagtggatacgtttcgttaacatttatatatcaatagtagctttttgggcataatgtctcaccttcaaaattaattcattagctcatgtttagggggaattttatgttggctcagagcgtaatatttgacttaggcagactaatatgtagattaccaacctatcagatctgtgcctgggccctaccttaggtaatacagccctttacttagcaaattaaaatcagacttatttcaggcctctgtcaatatattgaatgcatatattgaagaaagtttcgagtttagttagtttatgtagatccttttttccctttttttccacttcttttttcttttctttttttcttctgagacagggtctcctgctggagtgcagtggtgtgatcatggctcactgcagccttgaactcccaggctcaatcaatccccccacagcagccttctgagcagctgggactacaggcacgcaccaccactcttggctaattttttttttttttacttttcgtagagaagacagctcactatgttgcccaggctgatctggaactcctgggctcaagcgatccacccaacttggcctgccaaagtcctgggatgcatgagcctctgtgactggccctgtttttgtttttgtttttgttttttaatattcaagcttctaagcatccatttgattttctttgctggttttcccaaactgacttgccaaaataatttttaacaccttttcccagaacatgaatatgccagcattaagtgactttctgcccaatggggaatcctaagtttgatagacagataagcatgaaggctcatcctgcttcaaaaactcacatacaaaacccaactcacaaaccaggttaattagaaggggagcgagggtcctggggattacatagcaatttatggcagagttcctcaagtctttttttttttaatgagcagtgattctatttataaaaataggggtatactttttgccacaccctgttgaagaaataatcttgtatctttttatgacaaatatttacttatttccttccatagtgttctcgcaatggaatatttacttcaaaaattcttagtttataattgaaaatatgtgatttctcccttttcttttttcttttctcttttttttttgagacagagtctcactctgtcgcccaggctggagtgcagtgacacgatctaggctcactgcaacctccagctcccggattcaagcaattctcctgcctcagcctcctgagtagctgggattacaggcgcaggccattatgcccagctaacttttttatttttagtagagacggggtttcaccatgttggtcaggctggtctcaaactcctgacctcggcccaccttggcctctcaaagtgttggaattacaggcgtgagccaccacacccggcctttcccttttctattattctttggatacctctctcagaatggtcacaatgaaagtatatgaatgagcttgttgaagtagatgtggattacttctttgatcaaatcaaaaattatttccatgttgcagcacaaaacgttctgtaatcctctaagcatctgggtaagtctagttccaggattcaaatccatataattttcattttcatggctaaaatggaggaaagtataaaaatatatgtaaatagataataaaggtaactccattcatctttctgtatctttgaatcggtgtcttgctcttttgatgttcagtgtttggtcttagatataactcctgtgttttgttgaccaagatggaattcatactggtataagtggtcatttcgtgagtccaaagtagaactgccataatgacctcattcttctctacttgctacctaatccaggattttaatgtaggctagtactgtacttgtgacctattttgtcttctaagcttttaagaacatcatgatttgacatatattgggaatgcttagataacactgcctgccaagcatgtaaaaggtaaactcagaaatgctcaggtaaactcaagcatgtgaaaggtaaactagacatttcagagattaatctcagacagtagaagataccagagacaatttttcttccaactcatctttatagacattgaactaggccagtagttcttaaggcttgctgtgcatttaaattgtctgagagtgatattgaaaagctccactccaaggttctcatttgttggagttgggatgtgattcacaagtctgcatttttagcaagtatctaagttaattctgatgcgaaatacttgagagccacactttgagatacactgattaagagatttttgaaatcctatttattcttgataatgtatgttgctatctatcacaatgagaataatgctcatttagaattatggatacaagaagagctcaagttagtgggccaatggatgatttttttaaaattcctttcatttttctgcattttccagatgttttccagagagcaagcacctatggattatatgagaagacatattttttgcatagctccgagcacatagtatatttacactttaaacactgacatttcaacaatgtgtttttagggttttattttttagtaataaaggcaatacatttccattacagaaaaattacacaattcagaagagtataaaagtgagtttcacaaaactatcttgaatctctgcatcctggtataaaacgctgaccttttaatagacatttttaggtacttttattgatttttcttactatttctcagacattcccagaaacacatctctgagtctttatttttgtgctccctctttttagcaagattttttcaccagatgtcttatattttgctttccttcaaatgtctgctcagtatcacctatgaggacttcctgtgccatctttttattttttattttttattttattattattatactttaagttttagggtacatgtgcacaatgtgcaggtttgttacatatgtatacatgtgccatgttggtgtgctgcacccattaacttgtcatttagcattaggtatatctcctaatgctttccctcccctcttctcccaccctacaacagtccccagagtgtgatgttccccttactatgtccatgtgttctcattgttcaattcccacctatgagtgagaacatgcggtgtttggttttttgtccttgcgatagtttgctgagaatgatcgtttccagtttcatccatgtccctacaaaggacatgaactcatcattttttatggctgcatagtatttcatggtgtatatgtgccacattttcttaatccagtctatcattgttggacatttggattggttccaagtctttgctattgtgaatagtgccgcaataaacatacgtgtgcatgtgtctttatagcagcatgatttataatcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgtcattctaactggtgtgagatggtatgtcattgtggttttgatttgcatttctctgatggccagtgatgatgagcattttttcatgtgttttttggctgcataaatgtcttcttttgagaaatgtctgttcatatccttcacccactttttgatggggttgtttttttcttgtaaatttgtttgagttcattgtagattctggatattagccctttgtcagatgagtaggttgcaaaaatgttctcccattttgtaggttgcctgttcactctgatggtagtttcttttgctgtgcagaagctcttgagtttaattagatcccatttgtaaattttggcttttgttgccattgcttttggtgttttagacatgaagtccttgcccatgcctatgtcctgaatggtattgcctaagttttcttctagggtttttatggttttaggtctaacatgtaagtctttaatccatcctgtgccatcttttaaaaaaattacaatgtgagctctgtcaccagaacaccttttcccttttccctccattatttttatttttctctattccacagattatcttgagagatatatataaaactcaagataattgtgatatatactacacatatacatatatatttatatatataatttacttatctgttttgctaatttcctttttttaaaaaaggacagagtctcactttgtcatccaggctaaagtgcagtggcatgatcatagctcactgcagcctcgatttcctgggttcacgtggtcctcacacctcagcctcatgagtagctgcgactagaggtgcatgcaccacacctggctaatttttgtatttttgtagatatagggtcttgctgtgttgcccaggctgggcttgaactcctggcctcaagtgattctccaaccttatcctccccaagcactgggattaaatacacgagcccctgtgctaattttgtgattccctgctacaagaataaaagctctgggcatgcgggattttttttaatgcttttttttttttttttttttttgctgttcttgcctagcacatagttattgctcaataaatatttattgagtggatgagtaaattgtgcagtgattactgaaagtttaaaaagtcaatggaataataaacttccccaaattttaccatctagaaatagccaaatatttaccttgagctgtatatccttttagtttttaatgtgtatgtgtatataggtatatattaatttttaaatgcagaaacataagtctgacatgccttttaaattaactacatagactttatcaaatgattaatttataactactcttttcatattaagatgttttatgtatatgttaatattttttccagtttttttctttcaattttatgatctattttaacaaaaaaaattcaagattttgtttcataatttttgtaatttcatgcttttttaattataaggtgactgagtcaatttctaatattgtgagtcgatttttccctaaatatcaggaaacaaattgtttctactgattacctttgttaaatgagaaatttaccatatctttgttttcttctattcttctcctaagctctagtacctaggaaaacaatataagattttaaagttttgataatgaacattttaggttatctgtcttctctttcaatcattactttgtcatttccattttcataaccatattccattttctttgcttaatacattttaaaaattacattaacttccatatttgagctttgttttgattcatttttaaaaagactgtaattttattcaagtaattttttaagaggaatacatgtgtaaattgccttctaaatctttccagtatgagaatgtctttctgttcgttttcccttcacacatgtatgatactttggcaaattatagaggagtgagatcagcattttgggaggctgaggcaggagggtcacttgaggatagttcaagatcagcttgggcaacatagtgatgccctatgtctacaaaaaagaaaaagaaaaagaaattagccaggagtgttagtgtgtgctgtagtctcagttcgggaggctgaggcaagaagatcacttgagctcaggagtttgaggcttgaatgtgctatgatcgggacactgtaccccagcctgagtgttgcagcgagaccctggctcaaaaaaggaaaaaaaagtgagatcacaatagttcttcagtttaataaagttattatatcactgaatttgggaattttgtgcagtggtgaaaaatgatgccaatctgtttttttccacttgtacataatatttttacaaaatacttcttagttgctcattagagtgtaaagaaataaattagccttgaatttgccttaatatacccaggtatggatagttaactgtatgtttacatatataatatatatatatatatatatatatatatatatatatatatacacacacacacacatatatatacatgtaagcaaaatatgtgtatctgtatgtatatatttaagcaaaatatgtatattgcttaaaacaaaagcacttttgatctgcctatttagagtctttttttaacccagtaaatgagttgtcgttgttggttttttttttttttttggctgcatctcagattgttgtttttgtttctgtagttttacttgtgctttagctttttctaaaaatattcttaatattttagtttgaggtttcattccttgtatactgtatctttcaatttctctaaattttaaaaaatctcttattttccagtgttttggaagagttttttcactttgttctctgaatcattgatatgatttttttttgcaatttcagtttggctctttattgctctttaatgtggatttttattctgctgttgtcttttgtttttttcataatcattattttagccatctcatcctgcagcctctttatcttagctgatagtatgttcattcctactcctgaatgagaggcggcccatataggctattgattaccaaaacacagaatgtgtaggtttctgcaggccccaaactctttcttcttggatactggatcaattatatcactatttgatcaatgtcaaatctccttcttatatcaacattgatagaaatctatgtcaatgtcctaatctaataggcattgtctagcagactttctattatgtagtagattcttttttcctgagatggaactttctcccctctgcattgactcaatcaatggggaaatacatgaaaaaaataaaaatactttttgcttccacctataatatattgctgaagagctacacttccttagagtatagtactactgtcttatctcactttttctcccaattttttttttttttttttttttttttcactaagagctgtagtcactgagtaaatataagggcgggggtcatggactgagtgaagaaggatagaaaaggtacatgatggaaatgagaaagacagtactacagctcccaggccatgcatggtttaatagctctgttactttctggttgacattgatcttgtttttctaaattgggggcatttaatgaggcaatgacaatgtacatttatacatacgtcctgggagaaagcttctaaaatttctagcagcattgtggatggtccatctatggcactctgtagttcctttcacgtagtacctatgacaccgattatagtaccttagtgtttagaggaaattcctcccagattaaaatgtcgctgatgctgaaaccttattttatatgtgactatgagttttttggtgtatttttcctgtgataagtgccaattagggttctttcagttgtaggcaacagaaaatacactcattttactagctcatgtaacttaaaaaaaaatctaaggatagagttggatgattgtatgtatcattcataactagcttcagtgttaaattgatgtcattgtgactcagcccctctctactgtgctggcttttttcaagctacaggtagtagcctcaagcaattctacatatctcctcatgataataaaataacttatattatctctgatttcacactacctgtggtttagtccacagaagagaaaggttctttttctagtagtgcccataaaagtcctaaatttcaagattaaacacatttgacccaggcaaccactgattgctttctgtcactaaatattagtttgcattttctagaactttgtataaatagaatgatacgttgtgcactctttttgtctatattattctactcagtgtaattatcttgatatttatgcatttgttgcatgtatcactagttcattccttcttattgctgcagaatattccattatatggatacattttttaaatccctttgcctactaatggatagtggattgtttttagtttttgactattataaataaatgtttgaatatttataataaataaataaataaatgaacacatttgaatttttttcccatcactgaaccattaaaatggctagggaaatgatgagtataaactggaatcacctgctctagttcagggactggaattttacctaaaccgggactgaagcagaggagaggatcatcaaatacaaatgtaatgattgcacaaagaagggaatggaggtggtggggaggcaaacaacaaatcttcattatggtgtttaagtggaaagttggaagagattctgtcaggatctgctagaaatgctattttaacctgaaacacttgtatgcctctatagcacagatgactcaggcatattgaacctacaaacaaaatagaactttgaatcttgaaacttgtgggaacgaaattcttcaactggaagataaaactataataattttcaattaaaattatattttgctgcttatctctccaattctactcatattttgatctttgtcatgggctttttgtcattttttaattaatttattttgttcattaaaacatagttatatgtatttatggggcacatatttatgatacatgcaatatagagtaatcaaatcaggatagtatatctgtcacctcaaatatttatcatttcttgtattgggagcattcaaagtcctctctctggctatttgaaaatatataataaattatcgttaactatagtcttcctatagtgcttagaacactagatcttattccttctatatagctgtaattttgtattatttaatccatcttttcttatctcccctaccctgtaccctttgtggcttctcataagcagcattctactctttagttgtatgataccaacttttttagcttctgcataagagtgagaacatacagtatttacctttctgttcttggcttatttcacttaacatgtcttccaggcttatctatgttgccatgaatggcagcattttatttttttatggctcaatggtatttcattgtgtatatataccacattttctttatccattcatctgctgatggactttacgtttgatcctacattttggctatagtgctgcagtgctgcagtaaacatgggagtggagatatcttttggatgttctgatttccttttgtcatggggctgtttaatcagtaagtaatgaaatgtaaactaataagaaatgtattagaattggaaaaataaaacccagtttttattagcagtactgcaaatagtctctatttcttaatgcttttaaaaatttacacatagtctttactaaaatgtcaacatacacatacacactcatacatatctcaaatggaatgtctctatcaccagaaggtgattcatattgaatcaaattaaggaaacatcagttattctttatacctacatacatatgttgtcttcatacattttctggtgcttacaaaagaatacctgaaactgggtaacttgtaaagaaaataagtttatttcttaccattacggaagctaagaagtccaaggtcaagaggccacatctggtaaaagcctaagagccttcctgctggttgggactctgaagagtccaaaggcagtacaggtaatcacaaggcgagggggggtgagcatgctaacatgcttaacatgcttgttgaggtctcttcctactcttataatgccaccacttcccctcccatgataacctgctaacccattgagccactaattcattaatccatgaatggattaatttgttcacaagggcagaaccctcatgatctaatcaattttaaaggccccacgtttcaatgctgccacattggggattaagtttccaacacatgaaatgtaggggatgcagtcaaaccatagcagcagtcatcagtagctatttactatagtcagattggtggccatttactgaattagaaaaaaacaagtaggagcatattttgtggggaacatcataagtttttttttaataacttaaatttgagaatctatttaaaatccatgtggggatgttaagcaggaaattataaatatgaattagactcaagataaaaacttgggggtaaatgtatatggtatttaaatttctaaaactggatgggatcaccgagagaaccggtgtggagaagaaatccaaggactgatccctaggacgttctaaagtttgaagttcagggagatgatgaggaatcaaaacaaaaagattttaaaaaaacaatggggagaaggcactgaagtagtaggggaatcaaaagaaaacacttttctaaaaggtaagtgaaagagatgtttcaggagggtggattcaactgtgatccaacgtggcagctactgctgctaaagtagcaagtaaaatgaggaccgatcattgactagtggaggttttactaattttgctaattaacagcctgcttcttaatcctcaaatgcaggatgaatacttcagtcttaattttacttggcctgtctgaaatatttaacctgcttgagaacgttctcctttgacatttaacatattattttctctattatttttatttattgtatctctttgcttggttgtcttttcagactcctttttctttcctgtacttatccctcagacattggtgttactcaaaattgtgtatgaaatgcttatccagacctctgtattttaattttaggaatctccacctacatgtcgcactgacattttgcattcaatatcttttaatagagctttatcgctttatcccagaccctggagctcctactgaattctctctctcaatgaatggggctaagttattcagtcaggcagaagtctacaaatcttaagttctacctctcccttgctgccagttaattagttcagccccttgtctttctcatctacttatacatgttttgctaccctgtcccccagaggccttttcaaaatagtgtcaggatgatattagtaaatcacaaaatgggatttctgtgtgattttaaaatatcgttagcatgttgaaaatgtttcaaagactccccatctcctataaagtaaaattcacagttcttaccatgatctacatgactttccatcattctgtctcgcctgtctgttcattctcatgttccactactcctttttacgtgccattatactttaggcacagaaaaataatttccctctcaaagttccaacctcaccttttttttatacagccttcttggccacctaaatcataggcacatttttctttctgttcctccaaatatgtgttcattctctattatagcagctattgcatattgtttcatacatttatttgtgtctattagaaatgaagtcaagtgcaaataacagaaaatcagtaactaaaacagacttcctttttttcttataacaagatgcctgaagatggtgcaacaatagtgttagaattgcagcatctctgcagttttcttggcctttccttcggggatgcaagacagctgctgcagcgacagcatcacatcaatgttccggtcagaagggcaggagaataacaccatagatttccacttgtatctccttagctgaagctggatcagatgcccacacctaggcctctaattgtccagatgatgaaattactatgactgacatagaccaaacatcattctcctcctaggataggtaaacagcctttcctccctgagatcagtgtaattccacctgtaccaaaagaatgtgggactctgttggcagggaaggagacaagtgagaatggttgttggtagattagacaacatgtgtctgctgtgtgtctagctcttctgctctaagtttcttgaagcagcttttttttttctgctttgtttacttcttgtttatctttgtatctttaataactggctttagttcctggccatgatttatactatttgccaaaatgaatgaaataaaatgatgcaacagatatatatggattaattttttcactaaataatatgtcacattaatgagatagaaacataggcaaataatacatttggtaaggcaaaacgacaccaattctgcttgttgtattactatagacagtaatgactgaattttaataaccatgtatactcggggtgatgaaacatggtaattatatttaaagacaagaaatgaagaaggctgtaagtaattgacattattgactaattgagaatttcgctttgtaaaatatgatttgaaaataggcaacctaaaagtcgacctgagatttggctgcataaccgagaaatgcaacattacagtggcttaaaagtccaggttttccgggattgagacatcttccagttcccgttctactattctttggtataacccttgtccttaacgatccaagatatttgctaatgtgccaggcttactttccaagttccaaatggaagaaaaagggtgagctgaaaatggtatgccttttctcttaatgcaaacaataaatcccaatgctttttattttcaaaaatttgtggaaatatagtgtctaagatactttccattttaaaaattattttctccaatgttagattcatctgcattttacaaaatgcttttcatgggattttttaatttatttactttaagtcttaggaaatagcaaagatgaagatgaattttagacagggaaatataggctcatccaaaaatatacatacttttgaaaagcttatactttttctgctacatcaagccactttcataaaagagtaaaatgtttttctttgaattttaataaagactacatttatatttcttagaaataaagagtacttaaactgtttgatagattttcttagaaaaccaaattatattaaatagcaattaacttagaagtctattttttcctctaaaaattaataatattttattcatgaggcactgtggcatacgtggggcattttagacttgttatattaccctaatgcaagtgattttttaatgtttagactagaacaattagggattctggctaggaatttgggttaaattttcaggagatgggggctgagtaattcattaaaaagaactcattgactatgatgattatgattcgtgctacacaaacatatcattcagaggcaattcttcccttaggttgtttttatttttgtttttaagcataaatagaacattatcagcactcactaccaccaccaaggataccactagcagaatagataaatattgtacatttttgtgctttgtattcatggaatacagtattatttttatatctggcttctttcattatttgtgagtttcatctgtagggttgcatgtagttgttacttattctcattattatgaacttttccacacagtatgaatatactgtatcattgtactattaaagtatacttgagcagtttatactttataaatagaaatactgtgaatattctaatacatgtcttttgatgaacattacccattgctgttggctatacacttaggagtggaaatgctggtcatggggtatgtatttgttcggcgttagaggattcggccaatgagttgtccaaagcatttgccccagtttacgttcccctgagcagtatatgagtttcagttactctgcactgtcgccaatctgtggtattgtgcagtttagtccttctgttgggagggcagcagtatctctttgcagttttactttgtatttcccttatgactggtgttattgagcaactgttcatatgctacttagttatttggatgatctgaatttatcttcccttttgtccatttttctattggtttgccagtctgttttgttttgtttttgtttttgtttttttttggttgtaagtgtcctttgttgaacataggtgctataaacattttctcccttgcctttcacacttttaacaatgtcttgatgaatgcaagtgttttagtctgttttgtgttgctataaaggcatgcccaaggctaagtaatctataaagaaaaaagatttattaagctcatgattctaatgtctggaaaagttcaagactgagcatttggttcgggtctcaggctgcctccactcatggtagaaggtgaaggggaactggtgtgtgcaaagaacacacagcaagaaaggcagcaaggagctgggggtgccagggtctttttaacaaccagctttcctgggaactagagtgagaactcacccttttactgagagaaggcattaatctatttataagagagctgcctctataatacagacacctttccattacatccatcacacctccaacattgtgatcaaatttcaacatgaggtttgagggaggacaaacatccaaattatagcaataagtttgtaaccataatattgtcctatatgtcaatgttttcccttgtgattggcattttttgtgtcctatttaatgagtcttttcctatccctaagataagatgttatcgttagttttcttttaaagctttaatactttacttttgtatttacttttataatcatcctctctttttaaaattgttagcttactgtcgagattatatatatatattatatattatatatatatataaaatatatatatatatacacacatgcttatatttccataagggcattcaattatgcagaatcatttactgaaaggtctgttctgtgccccactgaattatcaccttcaccataaatcacttaacggtatatgaagagatctatcctggactcatgctgttccattagtcagtttgtgtatctttgcgtcaccaccaccctgttttaattataatagctttataatggatagtataacattaggcttgttcatataaaacctcagtcttttgcaagactcccttggctattcctgggcatttacattttcatatgcattttagaatttgcttggcacttttcatacataaaaaaaatctgctaggatttttgattaggattgaattaaatctgaagattaattttgagagaatttacattttcacatttaatctaattcattaactccatgtatctttacttttttgtttaagatttttatgtttaatttatgagagacattgctgtgtagttcccttcttacacgtctttttcaggtttggggaagatataaagaagtgagaagtgattccttttactatattctcaaagagtttatgtaacatttctttttgaactattttaaagaattcgccagtgaaacgatctgggcctggaaggttgtgtatgggaaaagttttacatgtagacttatattcatattcaggctaaacagattttctcattcttctatcaactttggtaacttgtatttctttttgaagaatgtgtccattcatccaagttatccaatatattggtgtgaaggtggatatagtattcttatttttttatgtcagtaagttctatagtgatgtatttttttattcctgataaggatctgatatggatatttgtgtttgttctgtatttttcttgatcagtccttctgtgagttgatataagggaagcagtgtttggtttagttgatttcctctactgaatgtttgtaaactatttcgttgctttcacctctttttggaatgatttccttttctacattttttgggcttgatttgcttttctttttccagtttttaaagatagaaacttaaatctttgacttttcttccttttccttttctactagaaagaagtgaaatataattgatgctataatcctcccccactcaagcattaatctagctgcaacccacaaatttctatgtttagactttgctatttagtgctaaatattttctaacttccatttttatttcttttctgattccaagattatttagaaatgcattctttaatttctagatagttgtggattttgtagttttatttattgatttcagacttaattctatcctgattttaaaatatactctgaatgatttcagcgttttaaagtttggttaaattttctttatggctctgcacacggttaatttttgtaagtagcccatgtttatttgaaaagaatgtgaattctatcattattgggtacagtatcatatatatgtcagttgagtccttttctgtatgttgttcagatcctatggggttttatctgtttattctatcagctattgagatttgttacttaaaatctaccattatgagtgtagatttacatagttttcctttaattgtgtcattctttttttgtcattcttgctttatataattgaaaactatgtatgtcatttggatgcaaccagttttaggattattatacatttcagtctcattgtcacctttatctttaagcaacgttcctctctttttggtaatatttcttgcctcaaaatctattttatctttgatttacataagatctttcttttggttaatatttgtatagtttatcattttctgatctttgactttcaactattctgtaaccttttattaaagtgtgccctatgtaaagagctgaattttttaatgtagatgctaattttattttgatttgtaattttattttctcttattcaatatgtaactgttataattttatttatatatacaaactttttcttatttacagtttttgttttctgatttacaatttttaattaattacactttccttcaattaacttgctgatagtatgtttatttactgttcctttttataattaccctggagattccggcatgtaaatttgactcattatggtttaatacaaatgattacttttacctcttctttaatactaatactaactccatttatcctgctgtcttttgtgttactgttttcatataatttagtgctacaaatattttaaatttcataagacattacaatgatcattttgtatagttaatatttatttatatttaactacatattttccctttctgatgatcttcaatatttctaacattttcatgtttcttatccttctacctaaagaaatcccttatatttttttttctagaatgggtctactagcaatgaatttactaggttttgtttgtatgaaaacttacaatgaaaacgttcatattcttccatttttaaataatatgtttactgaatttttagttatctttttctcagcactttaaaatgtaatttctttgcattctcacttccattatttctgttgatctttgactgtaacatgaccatttttaagatttaatattttctttttgtggtttctggcattttagtgtgatgtgcatagataaggtatcgctttaacttaccctgcttggagcttggtagcttcagaaatcttagttttaaaatcagtttcagaaatttctcattctttatctctctttggtttcactatattatccctttcctctccttcttatactactcttacatacatgtttaacttttcagcataccttatctgtctcttatgctttgttctatttctctttttctctatgcattgattttggcctataccatttatttatgttccactgaactaatagtgacttttgggatatccaatcaactaataaactcatccattgagatataaatttcagccattgtgtttttcagttttagagtgtaatattcattttatttttattttaatcaattaatttttttttttgagccagaatctgtgtcacccaggctggattgcagtggcgcgatctcggctcactgcaacctttgccccccaggttcaagcaattcttgtgcctcggccttctgagtagctgggactacaggtgtgtaccactatacctggctaatttttatatttttagtagagacaggttttcaccatgttggccaatctggtctcaaactcttggcctcaagtgatctgccctccttggcttcccaaagtgctgcgattacaggcgtgagccaccatccctggcctttatttttatatatttttatatattccaattatctggtaaaaatacttcctttttcaactattttactttatttgttactgcacattaaagatagtatatgacctaaactaaagagaagcacagtatatactttgtcactaaaaacttcaaactcagccaggagggtactgtgatgaatgcttgtaatcccagctacttagtgactgaagtgggaggactgcttgagcccaaaactttgaggccagtctgggcaacatagtgagaccctatctctttaaaaaaaaatttcaaactggaatcactaataattggagagtgttgtcagctgcactattttttcttgttgttaaagggtgagcttggaatgtctgatcaaagtatgaaatactgaatcagaaatatttttctatgtagatttcttcaggcctttcagaacatgatagtggcgatctgctcaagtacacattttctgtggtaatggtaagaattaaggacgtagaggacctgctatagatgtggcatgaacaggctgagatgattatggcaaagtcaatacatttcctgttggtatttctttggatcccaaacacatttccttgatctaatccatcttcagcttatttagaaagacttctgttttcattcctgtcccatgatggggattatttattttttgtttctgccttcttcatctgcttgtccctgacattgcttctaacaatacttgtggattagagaagaatttgtactatatcccagagatagatttaagttgctgtgtcctgaaatattgatggttggggttggtagacagaaaactaatggaaaagtgaaaaggagaaatgaaattgcccaagtgaagttagaaaacataatctaattacactgtatctctatgtggacatgttaatttctgcattttccccttttaattttgttaatattagaaagcactgctgtggatttttagtatgtaatttctttttatttagattacgtacctgaaagcagaaattgtaatctaatgttttatagcagcaaaatgtactcattagcataattagcataaaataaacgtactccctcagggcttcttttagttacagtttctgttccccctccccaaaactctttcacaacttctaataacacagaattaattttgcttattttaacttactataaatggaatcatgcaatatgtatccttttatgtttgacttttgattatcatagttcattctaattattttatagtaccctaatgtagtattatactacaattttgatccccagtttatcagagtctggttcttagcaaagatttgtgggtctctcctatacccctaaacccctttctgtggcagccagtctctgctttgcatgtatgagtgccaagtgttgtatgtatgagtgctgagtgtttgcatgtatgagtgccgagtgttgtatgtatgagtgctgagtgctgtatatatgagtgctgagtgttgcatgtatgagtgccgagtgtagtatatatgagtgttgagtgagagagctttttttgcatttcctcaaacagtggcagatctatgtcttgtttttggacagaactggggactaagatttttcccagcctgctccctagggtatgacagcttttgcttcttcccttttcctagaactggtgatttttccctggttcctagggtcagaaaggagagttttctatccctcctcagagacaaatgaggtttgcttttactccttctccattgttcctggaaatgaaggtgttccatttatgtataagtggaaacaagcataactcggaatttctgtatttttgcctgcctggtcattattttattaaatactgataatttaatgttatcttcctccagagagaatatacttttgcttatggaggatattagagtagggcagtgctatagattggatgtttatccctgaaaaatccatgttgagatttgatcccccatgttgcagttagggtatagtgaggtgtttggatcatggaggcagatccctcatgaattgtttggtgtcatccttgcagtaatgagcaaattcttgctctattagttcctactagagctggttgttttaaaaaaaaaaaaaaaaagcctggcatttccttcctcttttcttgctccctctctctttccacgtcatctctgcgcacaccagctcctcttcccctctgcaatcagtggaagtaatctgaggccctaaccagatgcaaattctggtgtcatgcttcctgtatagcctgtagaaccatgagccaaataaaacctcttttctttataaattacccagccttatagcaagacaaacagatgaagacagacaggtcacattattctagtcattaaatgaatttacttaagttgagcctcaggctttgtgagaaatggtctatttccatttcttccttattattaagatataggcccatatggtcctcactgaaaggacatcattatcacccaatgccaagaccagcttggtcagggagaccctagtggtgctagaggaattaaagacacacacagaaatatagagtatggagtgggaaattaggagtctcacagccttcagagctgagagcctcgaacagagatttacccacatatttattgacagcaagcccatgataagcattgtttctatagattatagattaactaaaagtattccttacaggaaacaaagggatgggctgaaataaagggatgggctctggctagttatctgcagcaggagcatgtccttaaggtacagattgctcatgctgttgtttgtggcttaagaacgccttaagtggttttccaccctgggtgggccaggtgttccttgccctcattctggtaagccaacaacctcccagcgtgggcatcatggccatcacaagcatgtcacggtgctgcagagattttgtttatggccagttttggggctagtttatggccagatttgggtgcctatcctcagcaacctaatagatatttacagaacattttatccaacagctgcagaatacacatttttctccccaacacatgcatcatttataagaggagaccatatgttaggtcacaaaatgtcttaaaaaattcaaaagagttgaaatcatatgaaatatcttttctggtcacaatggaataaaactagaaattagtaacaagagaaactttggaaactatacaaacacatggatattaaacaatatgctcctgaatgactggtgggttaatggataaattaaagaaattgaaaattttttgaggcaaatgaaaatggaaacacaacataccaaaacctgtgggatatatcaaaagcagtattaagagaaacatttacagcaataaatgcctacatcaaaaaagtggaaaaacttgaaataaacaaactaatgatgcatcttaaagaactataaaagcaagagcaaaccaaacccagaattagtagaagaagtaatacatatcagagcagaaataaatgaaattgaaacaaatacaaaagatcaatgaagtgaaaagttggttttcagaaaagataaataaaatcaacaaactgtaagccagactaataataaaaaagacctaaataaattcagagatgaaaaaagagatattacaactgatactacagaaattcaaaggttcattgaaaatactattagcaattacatgtcaataaattagaaaacctaaaaggacacgcaacctacaaagactgaaccatgaagaaatccaaaacctgaatagaccaatagcaagtaatgatatcaaaacgataataaaaagtctcccatcaggaaaattcagggcacaatggctttactgctgaattttaccaaacatttaaagaaaaaccagtaccaaatttcctcaaattattctataaaatagaggaggaaagaatacttccaaacccattctttgaggccagtattaccctaataccaaaaccagacaaagacccaacaaaaaaagaaaattaaaggccagtgtttccgatgaatattgatgcaaaaatattcagcaaaatactagcagactgaattcaacagcatattaaaaaagaccattcatcaagaccaagtggggtttatcccagggatgcaaggatggttcaacatatgcaaatcaaattatacatcatgtcaacaggatgaaggacaaaaaccatatgatcatttcaattgatgctgaaaaagcatttagaaaattcagcattccttcatgataaaaaccttcaaaaaagtgggtgtaggaggaacataacacgacacaataaaagctatatacatactgaatgggaaaaatctgaaagccttttactattgttattcaacttagttttggaaatcctagctagagcaatcagacaggagaaagggataaacggcatccaagttggaacaaaagaaatcaaattatccttgtttgcagaggatatgatcttatatttaggaaaacctaaagactctaccaaaaaaaatagaactgataaattcagtaaagtcacagaatgcaaaatcaacatacaaaaataagcagcatttctatatgccaacagtgaacaatctgaaaaggaaatcaaggcttgatgcggtggctcacgtctgtaatctcagcactttgggagggtgaggtgggtggatcactagcggtcaggagttcaagaccagcctggccaacatggcaaaaagccgtctctactaaaaatacaaaaattagccgggtgtggtggcgcatgcctgtggtcccagctactttggtggttgaggcatgagaatcgcttgaacctgggaggcggaggttgcagtgagcccagattgtgccactacactccagcctgggtgacagagtgaaactgtgtctcaaaataaaaaagaaagaaaagaaaagaaatcaagaatgtagtcccattaataacagctacaaataaaataaaatacttgggaataaacttaaccaaagaagtgaaagagtctataatgaaaactataaaacattgatgaaactgaagaggacacaaaatggaaagatcttccatgttcaaggattgaaagaatcagtattgttaaaatgtctgtactacccaaaacaatctacacattcagtgcaatccccatcaaaataccaatgacattcttcacagaaatagaaataatagtcctgaaatttatatggaaccacaaaagacccagagtagccaaaagtcatcttgtgaaaaaaatggagaaatcacagagtacttgtgtgcttgactattcaatgcctgcaataagttttccgacaatgaaaactactttacttcattttctattttattttaattactgatatttaatattttatttttgttatttatttctatcactaattttaataggtaataagaattttctgactaaaataagttaaatgtgtgattttaatgaaatatcaattagattcatggacatagatacagggatgcgaagatgtgtaataaatttcctcaaaagtttcttcttacctcagttactgctgagtgatcatgacatgcttcccctctgaggtcagctaaaggtttcaactctgcaccccagggaggggtgagagttaaaacccatttaccattcttatactaaatgaaccagatcccatctattctcatataatcaaaatacctggagtacaacaacaaaagtattttttatgcaagataacatttaatctgagattacataatgtgaaatatcctgcttttcttattccttgcaaatataataaatagtgctcatggataagtatcaggacataagaaataagaactattatatgctctatgaatacggtattttatttacactggacttataatagtataataaagactaacttggtgatggcatgatgacaaagtacttttactaattcaagttttattttactcttaaaaaaacaccaaaaacaatttcttaagtgattttgtttagctgcttccccacaaggaattggatagtaatcccattttacttagatacatttccttagatcttttccaagtttcaggaatatatgccttcagttcatgtgaactgtcactaggtgaccaactttcatagccctgcatgtgccaattcactcaacatacattttgtatcttctatacaaagatgattaaggcttggtcttttggggaactcacaatttatatctacacaaataatcactatctaatacctacaaatatagatatgaaggagcacagacaagagatttgaggatttgagaaagtcttcaaaagaaagagacatttaatttgagtcttgaaaaacttgcaagagctcactactcacaggaaaaggtgaaagtggcagcctgggcaaaacatttaaaagcttccaggcaaaaagccttgaaaacatagaaggacaacatatatttcggaaatacattgaaagcagagaacagtaagtaaactattgcattagtttgtacaggacacagtgaagggtttcattaaaagtagtggcattagtaatgaagataagggccttctgaatagactttttcaaagtaatttgataagacttggcaattaaatgtggtagtaggaggagatgaggttgatggaataatcaaagatgatttgatattttcatctcaggttactatctagaatataatgatagtcattgaaatggagaatgtaagagaaagaatatttggggtggtagaaaggaaaaccttacttgaaagagatacattaggttttaaatatgttaatattgagattatcaggtaaagggctgagagatctagattcagcaggtagctcgaaatggagtttaggagcttggtgtggcctgtaggttgtgttatgggagacacactggaatcactgaagcagagacaaggttggtagagttgttgggccagtactaggtaaaagttcaaagtagggtaaaaaaagctgatggcaggacttagataaagaattgcaactcaaaatacgataagccagagacaacaatgaagagaggacaaatccagaggataggataaggcaggcgattaaaaacctgagcagataggcaggaacaaggggctttgtggaaactagaagagcagggcagaatagccaaggtaacagattcaaggaagtcatcgaaatgttaacaaattaagcaagagattttgccagtcctggagcttgttgcagaagcaagaacctattccgaagcattatgacttgaggcttcactcagatattattgaaaatacttctaaagagtaaggaatcacagtagagataaggctgttctcaagtagctgcagtgataattatatttcatacttgtgtatcttcctatgccagaacaaaagctatcttactttttggatattgaagaatgaaacactcaaattacaaacattgtaatttcccccctcccctaccctccttccttcgtttcctttgttgcttaatacccttttcattattttactcattttctctttttctcttcccttccttctttcctcgcttcctaccatccatccttcagccctttgtccttccttcattttgtctctgttgaagaaaagatcgcttagaacctgttgtatgttgagttaagcatctaaacattacagaggatattttgaagtccaaatattctccagtgtaggaagaaatatcttactcatcatggctagtaaatatttccttctaaaaatgagtaaaactaaaattaaattacattcatgtggttttgactctgttgaacgtattagcactgtattaaatggtgtctttaaactttttgacgggttaggtggttagcaattaacttaaatgtaaaatgatttaactgtcaactatggggctggaagcaaacagaaatataggattggttttgtcattgtataccttttaacttagaaagcttcagttcctgaggttgaaaatgtaaatcattttctgctgcccattttgtgatttttatggataccttatttttaacttggtaacttttagaaatcattgacctgtttcttataaaagttaaatctaagattgttttttaagaatgtaaacagaaaggttaataaaatatttgataatagcattctctggtactatccaacattattgtcgatttctttcttattttcttatttacttgtaaaaaattaaaattgtttcagctgaaatatttgtgcagttctagccttttgtactgaacatcatttcacaagggagattttggtaaatcttgtttggttgaaacacattgttgttactttaggtgctgactattctgatgccgagtttccaattgccttgattaaagtagaaacattctatggcttggatgacttacatttcaaattggtttgagcaagatgattggtatgaaggactacaaagagtaagatacatttacttgtaattacgatttcctgcgattttttttctgctttgcttctcatatagttttatatctgtgtcatttatatcgtggacattttcgcattgcaaagttctgagcgtgaataagacacttatttgctagttttaaagcaaaagtaagaatataataagggtaattatatagtgaagaagaaagggcatttttttctatcctaatttcagatgagttcttaatgttttcaaattctcttaggctttaaatataaaataatattttatatattgagattaatatatgaaaatagcaacaatttcaagcaagtctttcccataaagaaaatcatttcatgaaacagaagataaatgtatgctgatactacttattaaacaaatactttaaaaggaaatgaaaacaattctgaagaagagtgccatgttgcatctgataaatttttaggcggttaattaattatgtttgaaaacaaactgcattgttagtgtggcaacatttgcatagtgttttgaaaatagtattctaacctattattacaataatagaaaaaaatgctatttaaaatgtaccttgtcaaatggatttagtctagaataatatatgatttctcttcgattattttcactttttaaatttcttgattatttaaatgaagacaatttgtatatttttattttattaattagtgggacaaaaaaaccagactatgtgcagttttactagatttttcaccactgttgttcaagggcataggctgccaatgatatacagtactttatttttctttctttttcttgagattcccatcctaagcacattaattacagatattttctcagtattacttctttttaattataaatcctcaacagtttaaagccttttggacttttttttcagatactttttttgtaagctgtgaaaaaatccagtaaacatctctggagccagtaaatatctaactctgaagaataatactcatattgtaaatcctaaagcattcttcagaaaaggagttgagagttaatgagcagttttccatcctgagtttcaatttcaggtataaatgatggaaatatttcagcttatgagtttaatagtaatacttcaagccccacttacacacacacacacacacacatacacacacacacacacacacacacacacaatgccaatatccttgtttgtattgtgtgcaggaatgggaactgattttaagaaaaatgctttttaatgaaatgtgtttcctttaaaatgactttggagaagctcatggagattatgagaattcaaaatcttcctcttcttgccctttatactactatgggcctttataaatgaatgcctggttttgaaacatactaaaagtgtagctgttgttaaaatatagaaatagattgaccctaaaattactatattactgtgagtttgagctccttccggcttaagtattgaccagctctcatacatgtgtagatgaaaatgaaagatcctattctgaatgaaaaaaaattggcacatgaatattgaccttaatttctttcaaaaatccaacttatgccctcctggtgcttaccacaggctgtgttcttacactgactgtatagaatgagaaggtagaataaatctaccccatatgcacttcagcccaactgaagtgtgttgttcctgggccaaaaagactgtattttctgaagcaacaaatctttgaagtagacatgaaaattcttgagtggttcacatattaatgaaacattctaaagtaaggataataaaggctttgtaaaacatttatctgcagtatattacctgtcataattaaatatgtttctttacctttatatgtgacatattttgtaggatttatatttaaaatatagatatatattttgaaatggaccttcagtggactgttttctgtttttagtaatgcagaatcatgaattgagtaacaattcatgctgactacaaagataacaaaaggttctggacattttgtttcatctccttggcaactgtagatacaatttaatgaagactgaataattattacatatcttttttagtccttttgcaaaaataatttagaaattcacatattagactttgtttgaatatgtaattcagattttaaatgtaataatatatattcaataatgtatgatatgctttttatcttttatttagaatcatagattttaaaaaatatctattttttttgaaatagctattttattttgtcctaattattattttaatatctggtttagcaagttatttgactctgaattttaaaaggatttaagtgttggtttgtaagacctgtaaaagctatttaagaacaaaggtacaccaaattttatgtcaacatagaaatgcttatattatctaattttggaaactaaaaaataataaatcaagatatactctgagttaaagtcaaaatgtattggcataaatttagaagtttatttttgtttttaataaataagcagagaaactgctggtttctagttcagtatgtaagcagcttagaagttgctactccattttagccaataaaaaattgaacgcattgaaaactcaacaactcttcctagatccacctgagaagtaagggcacaaggcaaatcactgccctcaaaattattgagatagaaatgcagttacagagaattgcaacttaccagagcagaaatgaattagcagaaactaacctgggcatcactgccagagtaagaaaatctgaactgtaactgataaattgatggaagcacaatatggtcaggtctgagggttaaaaacttcacgggaacccagtaatgggggtggcgggggagcttttgtaagttttacttccaggagctctaaactggtgctcacagtgcatattagagaagaatatcctcttgcttccagcagggggaggggaaaagaaaccacttaaattacactagagcattctgttctttatttttaaccaacttttaaaataatttatataaaattatggagtacaagtacaattttgttacatgcatagattgcacagtgatcaaatcagggcttttagggtatccatcacctgaataatgtacattgtaccattcagtaatttctcatcatccaccccctcccactccttcacactttggagtctcccttgtctaacattccacttttgtgtccatgtgtacacattttttttactacccagttatgaatgggaacatgtgatatgtgactctctgtgcatggcttgtttcacttaagataatgacctccagctgcatgcatgttgctgcaaaatacatgatttttaatggctgaatagtattccactgtgtatatataccacattttcattatctgatcatctgttgatagacacttaagttgattctatagctttgctattgcaaatagtgctgcaataaacatatgagtgcaggtatctttttgctataatgatctatttccttttgggtagatacacagtagtaggattactggatcatataatagctctaattttagttatttgtgaaatctccatactgttttccataaaaggtgtattaattttcattcccaccaacagtgtatgaattctcttttccccatatcctcaccaacatctattatttctgtctttttagtaataggcactctgagtggtggaagattatatctcattgtagttttaatttgcatttctctgatgatcagtgatgttgagcattttttcatatacctcttggccatttgtatgtcttctttagaaaaatgtctactcatgtcctttgcccactttttaatgggattatttgtatttttgttgtcattgagttgtttggtttctttgtatattctggatattagtcccctgttggatgaatagtttgcagatatttctcctattctgcaggttgtgtgttctctctgttgattatttctttggttgtgcaggagctctttagtttaattaagtcccatttatctatttttgtttttgctgcctgtgcttttgaggtcatagtatacataccttgcctagatgaatgtccataagagtttcccctaggttttcttctagtatttttatagtttctgatcttgcatttaagtgtttagtacatcttgaattgttttttttaatatggtgatagctatgggtctagttttattctcctgtatatggatgtctaatttttccagcactatttattgaaaagggtatcctttcctcactctgtgttcttgttggccttgttaaagatcaattcactgtagatatgtggctttatttctgggatctctattctcttccattgatctatatgtctattttttataccagtaccatgctattttggttaccatagtcttgtaatataatttgaagtcaagtaatgcattgcctccagttttattcctttggttttggattgcattggctatttgtgctcttgtttggttctatatgaattttaggatcgtggcattctgttcttaaaacctaccctcaagagaacctatttgtccagagcgtaactctggggttttagaagagccttacctacctgggagaaggaaaatacccaacatcagcccccttcagccatcctgtcccacctaagcagggctgggggtactgagaagcactggtcatgggcacgtgactgagacctaatcataggactttagaatgctcactctacccccatatcttaccactacattactaaaggcctatttacagcactttcttttatgtagttcatcatgtgcacctcacaaacatttacatgataaacaaaaggcaaaaaaatacagtttgaagagacagataaagcatcagaaccagagtcagatacgacagaaatgttggtattatcagacaaggaatttaaaaaactacaattaatttgctaatagctttaatggtaaaagtagacaacatgcaggaatggattgaaggagaacaaagtgggataactaacactacccaacttaaagacttactatatagctccaataaaaaagacagccatggtatctgcaaaaggatagacagatagatcaatggaacagaatagagggcttagaaatagatccacataaatatactcaactgatatttgataaaggagcaaaggcgatacagtgaaacaaagatagtcttttcaacaaatgaggctggaataactggatatacaatgttaaaaaaaaagaatctagacacaggccttatatattttacaaaaattaacccaaaatgcggcatagaactacatgtaaaatgcaaaactgtaaaactcatagaaggtaacataagagaaaacctggatgactgtgggtttggctagcactttttagatacaaaaggtatgttttatgaaaaataattgataagctggactttattaaaatgaaaatcttcaatttttacaatatcaaacagaataagaaggcaagccacagaatggaagaaaatatttgcacatctgctaaagatctgttatccaaaatatacaaataatttatataactcagtaactagaagattgaacaacctggttttaaagtgggcaaaagagctgaacagatacctcaccaaagaatgtatattcatgacaagtgagcatgtgaaaaaatgttcaacatcatttgtctttgggaattgcaaattaaatcaattagataccactacacatctattagaatggctaatatccaaacaccagatgctggcaaggatgtggagcaacaggaactctcatttctgatgggaatacaaaatgacacagatcttatggaagacagtttgatgggttcttacaaagctaaacatattcttactatattatccagcagttgtgttccttggtatttatctaaatgaattaaacagctgtgtccacacaaaaagcagcacatggatgtttatagcagctttaagcataattgctaaaacacagaagcaacaagtatgtccttcagtagactggtggataaataaactgtgctacatctagataaatagtattattctgcactaaaaagcaatgagccattaagccatgaaaggcactagaaatctctctccccacctagacaacaattgcactggtacagtctgtctgatgtaattattttgtaataccagaatctatgaaggcttgcaacttccaggggaaggcttggatgataagttgaagttagtaagctttagttctcagcacagtggcagctactcatccctcacctcaagccccagggcagacaagtgagcatgtatcccagaagtatcttgcaagcagcttatgtgaaccagggtagaaaaaaaagcactctgtcctttatatatcagtgatctactgcttctgatcacagaagtgcagacaaagaggcaggcagccattgttattgcacctacctccatgttacaagctcctccccctccagctgaagcaatttcaaggggacttaaagggctgaatcccttaatttttttctttttacccttttgggagccatccattaaagcctatgcaattcaaaagcaactgcctatacaaagaaaattaggaagttactatgcatgaacagaggacacaggttcagaataaccctgagtagtccttatgtttatacctgaggatgatccttgacacagacagcccacaacaattgaaaacaaaaacaataaataaaaacaaaaacagcaaactctgatttccagagttaccatattactagattcaagtgtccagggttcaacaaaaagccacaaggcctaaaaagaaacagaaaattatgtttctttcagtggaaaaaaaaataaacagatgctttctgaaaaagacctgatgaaagatctactagacaaagactttaaaacaactgtcttgggatgcttaaaaactaaaggagatatggagaaagtcaagaaaacaatgtatgaacaaaatagaaataatagagatagaaaaccaaaaaaagaattgtagggctgaaaaatataataacaagtaaaatagaagaattcaaagacatatttaagaagaaaatattagcaaatatgaagataagacaatagaaaatattgagtctgaggaacagaaagaaattgaagagaagtaagcaaaaccgaagggacataagggacactatgaagcccaccaatatgcactcatgtgggagtaccagaagagaagagagagagatggaagagaagagagaatatttgaaggaataatggcagaaaactcctcaaatttgatgaaaaacatgaagtaaatttccaagagtttcagcaagctccaagaatttgaactgaaatagacacacatggagacacatcataatcaaatcttgaaaagcagagtgaatcttgaaattagtaagaaagaagtgattaacacatacatacagggatcctcaatagtataaacagcagatttctgatatgaaactttagagactggaaggaaatgggccaatatatttaaagtgctaaaagaaaaaaagaatgtcaaccaaatatcttttatcctgcaaaactgtctttcagaagtgagggagaaattaatacatttcccagtaaacaaaaactgagggagttcattatctttaaacctgctttggaagaaatgctcaaggaagttctgcagggtgaaatgaaatgacactagacagtaactcaaagccatatgaaaaaataaagatcttgataaaggtaaatacatggacaattataagtgctagtatttggaaacaatgctattgtttgttttcatcatcatttaagagaataaaatattttaaaaattcttagtatacaagtagtattattgtaactttggttggtgattccacattttattttctcttaatttaaaaaactaatgtatttaaaataattaattagtttgtgtttcaggccacacaatatataaagatgtaattttttgacatcaacaacttaaaggtgtggggttggagttttaaagaagctgaggttttgtatgtaattgaagctaatttggaataaagttaaattagagtcttgtaactttagcatgttaagtttaatccccatggtagccacaaataaaatagctataggatatacacagaagaaaatgagaaaggaattcaaagtttcactgcaaaaattaactaaacacaaaagacaaaagcgttgcaggaaatgaggacaaaaaaactatgaagcatattggaaatgaatagcaaaatgacagaagtaagtcctttatcaggaattattgtaaatgtaaatggatattaagctcttcaaacaaaagagattggcagaattaatttaaaaaaagatccatctgtatgccgtctacagttgattcacttgagatccaaagacacaaatagattgaaagtaaaaggatgaaaaaaattttttccatgcacagagtagcaaaaagaaagcaggcatgccctatattaatattagatgaaattgatttttagtcaaaaaagttcagaaaagtcaaagaaggacactatatattaataaagtttcaatgcagcaaaatataagttataacatttatacacctaaaaaacaccatcaaaatatatgaagcaaaaactaactgaattgaagggatagatagttctacaataatagttggataattcaataccccattctcaataatgaatacatcagacagaaaataagtaaggaaactgaggactcaaacaatatattaatccaattagatctaacagacatatacagaacaccctactcagtaactgcatacacattcttcttaagtgcacatgggatgttttctaggatagacaatatgtttggccaagtattaagcctcaatagattttaaaaagtagttatcatacattatgtcttctctgaacactgtgggataaagttagaaatcaataacagaaagaaaactgaaaaattcgcaaatttgtggaacttaacacactctccaacaaccaatggatgaaagaagaaatcacaagggaaagtagaaaactcttagagatgagtgaaaacaaaagcacaacataccaaaacttatgggatgcagtggaatcaatgccagggggcaaatttgtagctataaatgctttcattaaagcatttataggatctcaaattagcaacctatttttacaacttaaggaactaacaaaagaataaactaaacccaaaactagaatgaaggatataatatctaagcagagataaatgaagtagagaatagaaaaaaaaatagagaaaaagatcaacgaaattgtcaaacctgtagctggataaactaagaaaaagagagaagactcaaattattaaaatcacaaataaaagttggaacatctctacagattataaagaaattaaaaacgttataagatagtagtaggaacaattgtacaccaactaattcaataacctagatgaaatgggcaaatgcaacaattttaaaaagccatgctaaaattgatatagaaactcaagagaccctgaataacaaaactgggggactcgcattttctgatttcaaaacttgttgcaatactacagtaatcaaaacagtgtcataccagcataaaggcagttatatagaccagtggaatataatattttatcctgcaaatatatataaatttatatataaatataaaatagagacttcagaactaaccccttacatatatggccaaatatcttttgccaagagtggcaataccattcaatgcagaaaggccagtcttaacatatggtgctgggaaaacgaaatatccacatgcaaaagaatgaaattggactcttacctaacaccatataaaaaaattaaaatggatcaaagacacttaatgttaagaccaatatctttaaagcttttagaagaaaacagaggacaaagcttcacaacattggatttgacagcaatatctgggatatgataacaaaggcacaggcatcaaaagcaaaaaacatgcaaattggatttcatgaaaattaaaaattttgtgcatcaaaagaaaaacactggccaggcatggtggctcacatctgtgatctgggcactttgggaggctgaggcaggatgatcacttgaggccaggagttcgagaccaacctgtgcagcgtggtgagactctgtttcaacaacaacagaaaatagccaggcatgatggcgcatgcctataggcctagctacttgggagtctgaggcagcaggatcacgtgagcctaggagtttgaggttgcagtgaactatgatcatgccactacactccggaaggaaacctgtctgtagaaaaagaaaaagaggaagaaggaaagaaaaaccctatcaacagtaaaatggacagcaacccacagaatgaagaaaatatttgtaaatcacatatctgatatgggattaataccgcaaatatagggaaaactcctaaaactcaacaattacaaagaaacgtgatttacctgattgaaaaatggacaagatactttaatagatgtttcaccaaagaagttacggaaatggctgataagcacatgaaaagttgctcaacattattaatctttagggaaatgcaaatcaaaagaacaataagacaccatttcacaccaattagaatggctattatcaaataacagaaaatagcacgtgttggtgaggatgagttagccaaacacttgtgccctgttgtaatgtaaaatggaattgctgctgtggaaaacagtatggtagttttgcaaaaaagtaaaaatagaattattatttgatctagtatcccacttctgcatataaaccctccaaaattgaaagcagggtgtggaagagatatttgtacatccgttttcatagcaacattttttgtaatagctaaaacatggaagcaatccaggcgacaaatcacagacacgtggataaggaaatatggcatatatgcacaatggaatattattcagctttaaatcagaaggaaattctgacatacactacaacatggatgaaacttaaggacattatgtattcaagtcttttgcccatttttgaatcagataaatcatgtttctttgtcactcttgagttttaggaattctccctatatttgggatgttaatcccttaacagatatgtggtttacaaatattttttcccattctttgggtactattgatagtgtttttcccttccttccttcctttccttccttccttcctttttttcttccttccttccttttccttctttccttccttttttccttccctccttccttccttttttcttccttttttccttccttccttccttatttttttcccttttgtcccttccttccttccttctttctttccttcctcccttccacccttcttcccttcctcctgccctccccacttgcctccctctcccctatcccccaagacagggtctctttctatcacccaggctggagtgcagtagcatggtcatagcgcactgcaaccttacactcctggttgcacattatgaatgtatttaatacctttgaattgtacacttaaaaatggttaagaagttagattttatgttatgtgtattttaccacgataagaaaaggagaaaaggaaaagaaattagctatcgagccatgaaaagacatgaagccaaactaaatgtatattactaactgaaagaaggcagtctgtaaaggctacataatgtacagttccaactataagacattgtgggaaggcaaaactatggaaacattaaaagattagttgttgccaggaattggggagggggagggatgaataggcagagcacaaaggactttttagagccgtgaagctgctcttgcccatactgtaatggtggatacctatcattacacatttgtcaaaacctgtatgatggagaacatcaagaatgagctctaatgtaaactgtggactttgagtgataatgatgtgtcacataggctcatcagttttaacatgtgccatccggtgctgagtgttaatagtggggaaacttgtgttatggggtgggggaggctatgaggggtatatgggaaatctctgtacttattgctcaattttgctgtttttctaggaattgttaattattaaaaatgtgtaaaaaacattaccagaaagtgaaaattttaaaatgacttttgtttatttatttatttgagacttgctgtgtctcccaggctagagtgcagtggcatgatcacagttcactgcaacatgcacctcccaggctcaagcaatcttcccacctcagcttcccaagtagctggggctacaggcacgcgccaccacccctggttaatttttgtaatttttgtagagatagggtctccctacgttgcccagactcatcttgaactcctgggttcaagcgatccacccatcttggcctcccaaagtgctgggattacaggcataagcccctgtgcttggccaaataacttcattttaaatgtgtgtttaaagatttttctttaattatgtttcttttccaaatataaactcaatatttggttaaacagaaatcaaaagacatttttacttagatgcaaatgttataaatagtaatttaatagatccccacataatctccaaaagtcaatgtaactcacattgtggctgaaataatgtacattttcagcgaaagatactgtaacattactaagtgtaaaaaaaaaaagaagtgtatatcttttttatttaccctgaatgctaatgtttgaggaaatacaggtgtcattagacgaggaggaaagtttctgaatacataaaagcactcaagattggtagccctgtttgtttgtcatgccagcttgtacttcaagtaatttatttactttttttcctaaatctatcactaattctgctcagataaggggatttaatgagatgaagacagaaagaattggagaagagaagaggagatgagaagaaagtagatccttttcagaagtggaaatatgaaatagaaaagataaaatgaagaacgtagtttcgtaaataaatatgagttagtgatctatgggagaaaatgtaaccatttaaaatttactaattgctgagcattaaaagaattagattaagagttggaaggttcagggtgtacactgaacaagcttctataagacttgagatgtagatcagatgtgtataaatttatgtgtgtaggttttgtatgtgtgatattttacatgttgtggttttgacattaacattatgcaaagcttttgagcagcataaactaaatattgactacccaatatattagtcacgtaaaaccaaatttattatagctctcagttttctacttaattttccaagctaaaatatttaagattataatcactacttacattttttccttatttaaaaatcagatatgaaattgacaatagtgaaaaattgaatttacctggtgtaactttgtagtagtgtaaatggaagattgtctctcatattaggagctcctctctttattttttatttatttatttttattttttttgagacagagtctcgctctgttgcccaggctggagtgcagtggtgccatctctgctcactgcaagctctgcctcccaggttcactccattctcctgcctcagcctcctgagtagctgggaccacaggtgcccgtcaccacgcccggctaattttttgtacttttagtagagacggggtttcaccatgttagcctcctgacgtcgtgatccgccctcttcggcctcccaaagagctgggattacaggcgtgagccaccgcgcccagcctatctttattcctagaccagtattttaggccataatggaaagatagctaataatggcttggattctacctttaaaaggcattttttgtcaataatttctttttgaatgtcatttattagataaccacatagtttaatactctgcacaaatgtgttttttaagtatgattttgttatgatgagttttcattatgatcatagacttacagcctcaccatttactgtctgttctccagtatcttagaggaatttagagtttacatatagattcatagcatttttttgatctgagaggaatctggtagaaaatatagttcagaagctgtattttagatacgagaaatagagacgtaaggtttaatgcttgactccaagtcacactctatgtgtggtgcaaagcttggtctaattccttatttcctgaagtctcagcccaggcctgcttctgcactacgttgtctgcatctctggggttgtctattccaacatcctctgtcctgccacatagacaatttttgttcagatacttttcagcttctttctgcccgatcctaacagtgaacagtattgttaacctagcttatatacctgtcttatgcacctcaaatagattttgtgaggatgaagagttgatgtaaaaactgaagttctatgacacaggtcacaacccttccattactggtccacagtgttttaaatttaaacgtgatgccttgaatgaattgccagtattgaaaaatggatacatttcacataaaaatctgggtatttccgtttttctaggaagttccataaatcttgcaacatgggatggccttcttcagtgatactattaatatagcatgtgcaatttctatttcactggagttcctgtcactgggtatgtgtttcccagtccttggccaaatgtcagctgtcgttccttcattatcatatttcctgctttcctcatttaaattagttgccttgatgtctgcagacatttagggagttcaactgctgttctctgaaaataaaagtcaaaattaatagtactagtaaaatgtttttcagggcacacaggtaagggttggggaagatagatgtaaaacaatgaggaagtttatcaataatggaaatcactgacatttcttcaaatttgtttttcaaggcaaacatgtcccaggtaaggcaagtgggattgctggctgctggatgtcagccatggaacaaggatgtatgtgctgccagtggagacaggtttgcatattgtgcgaccctggctatctatatttatcaggtaaaataataattcttttccatttttaattatatccggtaaaattaatatttaattaatacatattttaagtccttgttacatgaaaaacataatgctataattccatttatatttatatttttaaagttttgtgatttataccgtataggttttaaaagttaaacctttagaaaacacttacattattaaatgattagtaaatttgatataagaaaattcttttttcagttgaagaatttgggtagtccattagagatcattatagtaaaattaggacagacatatattgtgagatattattgggagaaaaacttgtataactatgtttttcgtgtcctagctccattcagatatcccttatcagttcacaatttatagagccaaaaaccgcctgaatttcttcatatagaagtgccataagcatgttaaaatcaaagtccagtgattctcttaaattcaaagtcagtatctcagtgtcaccagctaaccatgcatctaaaccagaaatgtgatagttatctttgactccctcttccactcacatcccgtgcccttggtagccaagagtgattctaatatgttcctcatatctttctcacctaaactattataataatctcttaatagtctctacttttagtttggctcctactaatttattgttcagtgtaatcagttatctgtagtgcaaatctaaattttaaagctttcagttgctactcattccctaatagtaacatctaaacttcataaaatggcattcaaatgcttttgtgatcttcctgcctctctcttactctgtgttccagttataccaaaccaattacatttttctaagacatctcagtctttcatatcttgcctttgcttacactaatttttcagtttgcttacattgcctgtctagagaacactttctcatctttcgaatctcagctcctgtatgaactcttttccatattctattttcccctctttcttagcagtaaaggacctcataaaatggactgcctctctgcatgctttcatttattaggagtctttcccatcttttaattctcacatttttgcactttctggcacttagaagacattcattaaatgtcttaaatgaatgaattaaggaaagaatcttcaaactccaacttattttagttaagactatcttgttttattctagagtaaaaattcttttcattactacatattcgtacattactaattgcattatgctttattcaaaatttaagaaatatagcattaatgtataaaacaatccattttccacgatatagagtaagattttatgtagtccatttcttaagactgtagaaatatctagctaccaaaatggaacttcaatataactcacacttcttcattttcacccccttcatacacaacacagcagcaagacttctaaatgcctgtttttttctcccatctacctcctttacactctttatatactcccaagcttgtcactcccaaatcccacctacacaatttctctcctaaccctaagtccttatcttgtcttttatttcctcctaaagaagagaaagttatcaagcaagtcaaactattcttctgaggtaaggatggtaaagaaactcagtggatgaagccataacttaattttttcaagtttctatgtcttaaattttgtgatgacattttatgatgaatattttaaaatattgaggtaaaattagtaatataaacaatgtacatgaaagttgtcatgtcattaaggactgaaacaaactaaaaattatcctaatttagaagctgatgcaaataaacttaggggacagttcattacaatgtccactataaaaccttgtttcaaagtatgccaatagaaaattacataattaaatggtgacattaatatgaaatttatgttaataagtagtgttttaaatattatcatctcaattacagtgctttgaaaattatgctacataaatgtaacatgatacaattattttcagaggaaatatttattaaataacacttagtgccaatgtgtagtcaaagtctgataatcggtcacactctggataatgatactcttgtattatatttttctgaatgattaaatgataatgggaaatggtattagaatttttctttaactgttgttttgtaatgcactgatatgttaatgtaccctaaaagtagagtaatttatggtcaatctcaatgtaattgtacagttcaatattactgaattgtaaacatcataggaatgcatcagtagattaattcctgcaaatagttcagtgttctctagtgtgcttacagttactatgtagataatttgtatggtaatgtcagtggtcactgatatgcagcatagcttcttcacacatttactatattaatagattcttttactgaatttctaaataatgtaggtttttttcttttggatacattagatacactcactgtatctaccataggtgacttaaattgctgaataatttaaaacttaaaaacctatttattcctaaatgtatagaaaacacaattatgtatttaaataagtcaacttaaaattgctattgctgcagtgctaatcaaatgaaaacttcattggttttgggttatgtttactaatgttttaatccaaagttgtccaagaatagttgaagttataggaagagagagaaattatagaagaaaaagccttaggaaatacttatgtgattagtcaaaaattttacatacaatgttcactgcagcattatctgcgatggcaaaaattaagttacttaaatattaaacagatcttaagtgtttattctttcaatattaactgaatctcttcaattgaccaagccttactctgtaccaggattgcaactgtgaagaaacaggcagagtcttcttgtggaacttatattcctgtaaggtgtaaggaaaggtgataagataaataagtaaacaaataggtaaaattttcagaaagaagtgtgctctacagaggctgaaaaaacaggtataataagatagagtcatgggataggttctggggcgagttatgaattaagatagcatggtccgaaaacatctctcagaagaggtgcatttaaactcagacctcagtaggagaatgaataaccatgagcaaatcagtggatagagtatttagaagccaaggaagcagcaagcagaaggccatcaagtggaggtgatcggctgtaatagagaaacaagaagttcagagtgaacagggaggaacatgatttcaaattactttggcaagatagcagagattcaatcgtgtagagatttgaaggctgtttatcagttaggattttattgcaagcatatagctttaaaaagtttgatgtaataaatatttaatatcataatgatttttaaaacttagaatagcactgtgaaaggctcattatatgctaaaggggaagaaactacaacaaaaggacataaataacatattccaaaacatgctaaaaatgatagagattaattcactaattaatggaggcacacttacaaaagaaataagaaaaattaggctgtttattttttctatttatgtataaaaacacaatataatgtcccatccaaaaaaaacaataaaataaaaagagtgaatgacatcattgctctggaagctttggacatcttaatagtgtaataatgagcagttggtgtatttaacccaaattttcttgattcaagtataagtgaaaaattgcagaaaaaaatattccaaaaccaagggttttttcttctcataaaaagatatagctatggaaaatataataaagctctaaattattatgcatatttaaatgtgaaacatttatttttacttgtttttaaaatggatatgtttttattctctcagtttttaatgtttttttttagctggttcaatattcatgaatacacttgaatgtagaccaaggcttgaaatatgttcatatctttattattaggtgaaataattttcctgtatgtagctttagttttgtgtaatgtgaatattaacagtgtattatcttaaaaaggagcactaaaatattttatttatatattttgttttagttggatcaccgttataatgaattcaaacttcacgcaattatgtctgaacataaaaaaacaatcacagcaatttcttggtgtccacataatcctgatctgtttgcaagtggcagtactgataatttagtgatcatttggaatgttgcagaacaaaaagtcattgctaaactcgacagtacaaaaggtataattacaactgggatttattttatggaataaaatatttttatttcaacaagcactatcaatattattagttcagcttttaaaatgttgttttcaaacttcttaatggtaatctgtataagaaataaatttcacataatgactcatgcccataggtacaaagctgaaacaaaatttcatgaaataattatacgtagaacatatgatcgactaaaaacatagccaataccaaataattttattaatgtttaaatataatgtaagaatttccaaaataaatataaaaataataatcagaaagattttgttattgagacaagtaacaagccttggctgttcattactctattccaacctttaaattacaaagaaagtattatgcatatatttgatgcattgttaagctggtttcatgcctttatttttaatttggtcaaggtagaacatcctcattcacataaattggactttatgaattggaataatagcattatactctttctacttagaattgggaactcgcatttaatcttatcccatcataatggtaaagttaagtaataattattctgtgttcagtgtcacaataattaactctctttttgagcaccatatttagctcaattgattatggttttgaaagctactgctagatatgtttttcaattcagcttcttctctaaaaataattgttataaatttgagatataaaactggacatgacaatctcactaaccttattttgttcaaatttctttgtaatagtctaaggcaaaaatactgggaatttataggcaattatctttaaattttgtttccataataatagtaaaataatatcttttgtaacttttagacatatttgatatttttagtattttggtttgtcttttcaaatttaggtcattaagaatgcttaaaatatcagtgtaatacataaattttattactcaactgttaaagatatttgtcaaatgaagttaattttcaactagaagtatatggatctcattcccaagtttatgtaccctgttttttatttttacttagaacaaccaatgtattagacagtgagtaatgtttgccccaatctctgaacaaaatattgtaaaaagtcagctattcggtgagcttccattaatgtaattagcaatttttcttaaggctttccatgagaaaaaaacaaattattttggcacaatgctttgtgatatataaattgtgattgatggcctcaattaagacttttcatatctccccatgttttctggtcatatctgtttgtccagcaatcacaaattctataggttactccattactgtttatattgattgataatgcatttccaagtactttaaatccagctttgtgtgagattaattttaaataacacaacaaatttttcttgaaattctttccatattgtatgtgccataaactaaaatgttgcacgatattattgttctcgtaaagatgtaacacaaagtcaacgttaggttataactgcatataataaacataaattctaaatgttttgcagaagtaatgattaattttattatcacctagtgtatccatggatttatcatcagacactatatacatcacatccattcatgggggaagattttatttattcatcagctatatgcaccatagtttcttttgtcactggatatacaactaaataatactttctaattaacagtcccagaatgatgagataattgtggaaagcttttggcaaatttttcatgtttttcctttctttgaaaattttcagctatcaatatctccctcatccaaatgtcttcttaatttgaagattgaaagctttgctattttatttgcaaaaaaattatgactatttttggtgatttccatcttaagtaacacttttgaaatgttttaggcttatttttctttttagaatccagcttaagcaaagtagaaatttgcattaagtgaactttttttttcaacttccaaatacagttgttgaatttgatcttgcctctgtatttttacttcttcttccttttgtttctaataatctaacaatccatttaaatgaaaatgcatattagtttttccaaatgtaaaatgtaaaaattgtcaccaacttgaaaaagtcactttatgtcacagtggataataatactacctacctatctcagaatagtgttgggagaattaaattgcaacactccttgaaagtgcttgtacataagtcactataaaagtgttttctattattattatatgacactgtttctggtcctttcgctttccttgctgtctttctctaaatatacagtcggagaaccagtattctattgtctttcctctactgtgctgtggtggtttgatccatacagagtacctcatctcttttttgggtaaattctacttctgttaatgtatcctaaaaccatatcaactattttactggcgtttttcatgtatacattcattcattcagcaaatatttatggagtcctcattatgggtcaggccctgaagtaggcattaggctttgtttttgcctcttggagcacatagactgttaacacaaactaaacttactgtcaatcagcgaatttccactctgtgtctttgttcatatcattttctcttcctgggaaatactgcttattccatgtatttaaactctacccctccttctaggtataattcaaatctaatttctttccaggacagtagcacagtggtttctaaacctttctgcatatcaaaatcatttgatgaagcttgttaaaaataaattcctgtgaaacctcgtctctactaaaaatacaaaaaaaaaaattaaccgggcatggtggcgggcgcctgtagtcccagctactcgggaggctgaggcaggagaatggcatgaacccgggaggcggagcttgcagtgagccgagattgcatcactgcactccagcctgggcaacagagcaagactccgtctcaaaaaataataattattataaaataaataaataaataaattccttggctcaaactccacatgatctgatatgttatattccatttcatgattttgatgcagccagctaatatatcagtgttggaagatgtgcaatctctctctcataaatttctcataatacttattttatatatgatttatttgatcacaatagcaggtatattaacaattaacttttatattccatcttattgatggaatgtaaatgtacctttacataaatgattttatttccttgactttcatgtgaaataagtggtcagctatttttattgttatctccattttatagatgaggaaacagaaatttagagaaataaaatgacttgtttttctgaggcaaggcttagatttgaatctaaattcctgataagacatagattataacattaagtccattgtttttaaatccttatagtagcatttatatttttattcactaatccctgtctccctaacacacatttaaaattctctaaagcaggaatcttatcccacactaccttgtatacctagaatgcctagaggtcttatatacaaatacacagtaagaatgtattgctctaatctttaatatatagtctactaaaataaaaaagtctataaatgtatttgactatatgaagcaaatgatcatgtaagtagtatttaaacctaactagatacattttctttcatcatggactttccctgcctatgttccctgcagtctttgggatttctttataaatccaattcccaaataagaaagtaatgtatcttaaaaataataatttgttttagaaatgtaaacagggcaagtaatatttaatggtgtaatcttatgctgtatctttattatgtatctgtatttaatgtattccagggatccctgcttctcttagttggtgctggaatgcagaggatgtggtggcatttgtttcccacagaggcccactgttcatttggaccatctcaggaccagatagtggagtgattgtacacaaagatgctcatagcttcttgtctgatatctgtatgttcagatggcatacacaccaaaaggggaaagttgtgtttggtcatattgatggaagtctatcaatttttcatccaggtaagaatttaattagcaaggtatcttaaatagtatatttttcttatatataattttgtacttgcttggtctttctagtgaccagtccccattgtgaataaaaccaaaagtgacaaaattttaattttgatattattattgttaaaatgttacccagtattgtactgagtctaaatattcatttgaagttttatatatatatatatatatatatatatatataatacattcaacacagctgtgaatattttacttggaattaacctaaatcagtcatttttcccttatttgtatttttaatcaattctttatttctgtacatttactaaaaaacaacctgaatgaacaaggacatacagctagaggatgtgatggtttactaatactaaatattttcccatctgcttgtaaaaataccattctgatgccacggctccttggcaaaggctttgaaactggcataaaagaaaaatgataaccctttgaacccctgttagttaattgatttggctgaatgaaagggtctgagaaattaatgttcacttacaaaagtatgattaaaaaatcaaaaattacctgaattgcttgctttcccctcaaaaataagtattttaacatttgggaaacatacttttagctatctagtatctctgttgatgtatgtgacttctggctggctagatggatgaatgaaagtgctttctcaggaacacgataactactttcacaaaacaaattacatttaatttatctgaaattaatagaaaaaagaaattgaaattgaacaaatgaaattgtgaaaatttaaataaatctttcttcaggaaataatgtttctaaagttaaaaaggattgtgtaaaacattgaaacattggggccattatattctaaatacattttaaatgggatctattatttacctttcaaagaaagataaaaataaatgttcatatgcttcttccccagcttctctctcagctctttgtacacgtcctctgttgttccttctggttgtaccaggtttacgtggggacagtttcattgatttgtcaaagattagcatgaggagggatcaatgactggtgcttcttctggatttgttgtaccaagcacctgcactgcaacttatctgttctgtccttgcactggaaacagatcctgttttatagttggtcattaaggctgatagttaggcaatagaattcatagctttctttgttttgatctggtgaatacaacttctttctctgtaacctttgtctccggcagtcttccttagtctcaggaatgcaatctataataaatatggctgtatgctgtgtggttcctcctcttacctctctgcattatgtaaccaaatgtcattagtgatattcctccacttcttccctggcctgcacccaaagatttcatcaggattgtgacactttcttttcaaactagatctgaagaagatatgaggagtgtgtttttattttattctaaattgcactctagatattttatacattttgtgatttgtcatttttaccctctcctttatcattgactgaggttatcttttttcttgctttattattattagtcatctttgaaagtttcaagccataagacattgagactttttattgtgtatctaaaatataaaacattgagacagtgcatgcttattttgacatagaaataacagaaaagaaaaaagactacctttgttttccctctcttaggtttagaggatagaatgtttaatatttgaacagtctgagatatgtgccttccagaagagaccattgtttttcaataacccaatcttccagttgttaaaccaagtgaaaccatctatacccaagtcagcatgtgttatttttctgttccacccatatattagtttattagggctgatgtaagaagactatcacaaacaggacagcttagaacagcataaattttattatctcacagttcttgagggcagaagtataaaataaggtgtcaagagggccatgctccccctgaaggcccaaagaaaggatctgttccaggcctgtctcctggcttcctgttccttggcttgtggcagtataactgcagtcttcacatggcacgtggcatccctgctgtgtgtatgcatgtctctgtgacaaaattttcccttttataaagacatagtcatattggattaagctctaccctaagggcctcatcttagtttgatcatctgcgaaggccctaattccaaataagatcacatttgcaggtactggggcttaggactttaacaccttttttgagagagcacagttcaacccataacaacccaatacagacttgttaacctcatttattctgtaggatttatttagcaattaatgtgcacaaaacattataaaagatacagtcctgataagtattttccttttgcatatacatgagggaatggatcatgaaggaatcactaccttttaattctaacactacattctggattgtgagtttgaaactgttagcattaataccagtatagctaggcttcttacttttcatgagttgttaaccttatcttcttgatgacttactggcaccacagatggttctatacctacgttacaacataggatttctctcctccaggttcttgcaggaacctatgacctcaatatctctgttgtctagtccttctcagaagaaaaaataaatattcatgagaactagccacgataatgtagttcatcattttaaatcagtaatttttaaactgtgctttctatgtttgtatacttatgtgtgtgtattgagggtaggagggcttcatagatgatccagctgagctttaagccttcttctccctttcagcctgaaaagcaccatgttatcctgtattatttactggattttcttgtaaacattctcatatgaacagaagattccagggcaaaaaaattggaaaactgctttagctatctcaaattgtattctcaggccaagttcatcggagaacctttttaaaaatctttattacaatcatgtttaaattgaattgattttggtattactccatgaatgtgccttaataaaatttgccttgttttattttaggaatgttgttgatgacactctctatataactgttacttagtggaaaaaacagactcagtttctcctactgtactctcacagcacagttctgacactagatgtgtgagaggctttctccacacatgaagcaagcggtcacctctacagcagacactcgctgagcgtcctccaattcaattctgacactacctggagatagagtcacaacacacacactgagggatcaggccccattactgtcctctcttctgatgacagttgttaagccccagcttattttgcctgtgtttctgaatgactggctataaatcgaggttcccgtggccccctccttgcatttgattagtttgctagagtagctcacaaaactcagggaaacactttcttaccttattataaagaatattacaaggatacaaatgaaaagatgaaaagggcaaggcatatgggaaaggacatggggcttccgtgctgtctccaggcatgccgccctccaggagcctccgtgtgctcagctctctggaaactcccaaattctgcttcttttgggtttttatagaagctttattatataggcatattgattaaaacattggcccttggcgatcagcctaaccttcagtccctcttccctccctggacattgggggatgaggctgaaggtcccaactctctaatcaagccttggtctttcagtgaccagtccccattgtgaagccacctagtggccaccagctacctagtcaactcattagcatacaaaaagacactgtagagattccaaggattttaggagttgtaatgccaggaaacagggatgaaaaccaaacatatattttacgatatcatagtctcccctttaaaaacacacaggagacatttatttctggtctcaattctgtaattatgggattgcagcaagagttgtattatctttcaattgtgctttttaaagaagaaacacacttcctttacgatacttatgactaattggtactttctgttaaggccgcagtctctctaactagatgcttcactgcctctcttgagaatgagaggacttgcccagtggagttcccatgtggtatctcagcagaatttttttttccatatttccagttgtgtacataaattacaaagaacaagaagtttgtttgatgatcctttgctttatttaattagtcttgttttaactccctatctttctggcttccctatttatactactggttgggtgtgaattataattatggcaaatggtaagacgaatgagaaaggaataatagtaaatactaagatgctgtttaaaatgtgcaccactattctaaacattttaatcaaattcatttaatcggttttaaaactctgtgagataagtattgttatcttctccattattaaaaaaagaaaaaaaccacaagactgaggcacagggagattaagtatcttgtctgaggcagcaaagctagtaagaagcagaacaggatcggaaccaggcagtcagccagctctaacatttatccttttaaatcactatatgatattcttcatttcaataagcactttccctatttctatgctgctgtaacccagtgaaatttgtaattattgacaagatcagagtatgttatttatctgtatattttcttactgcttttcggtaacaaatgggagacacattcaaggcactggaaattgccaaaacagagcattgagcctgaccttcatcattaggacaaacagatctttctgcattcacatgtcagttacgccttctgcatataagcaccacatttgtattttcaataccctcagagatagatattgtacaaggaaaaagttagcatcatctaaattattgatcttttctgcaagttttttggaaataattatctctgtattttaacaggtaataaaaatcagaaacatgttttgagaccagaatctcttgaagggacagatgaagaggatccagttacggccttggaatgggacccactatctactgattatcttctagtggttaatttgcattatggaattcgcctggtagattctgaatcactttcttgcataacaacatttaatcttcccagtgcagcagcttctgtacagtgcttagcctgggttcccagtgctcctgggatgtttataactggaggtaagctaatccccataacccagagttttaaatacgtgtatatattctttcgttgaatttaggaaattgtcctttataggttgattttgtgtaaaatgtattaatagctcaattattatttattgtagtaaattactagtgtacttttatttatattgtatgtcattaatgataaaatgaaatgacaaataaaaatgaaaaataaggtccactctgccaggtttctggaaataccttggaatatattatatatgtgcacacatgtgagcatgtctgtgtatgtgcaaaagacaaagacagttccatttcaggcatagtaggatgacagtgaaggtactgagcataaaaacaattacctgatgggagctttattagcctcactgtcttagtccattttgtgttgctgtaactgaataccacagaatattctgctataacagaataccacaagctgagtaatctataaaccataaaaggtttatagtttatagtaatctaaactataaactagtttagattagtttaaggctaatgtaaagaggctgggatgcccaggagcatggcacaggcatctggtgaggaactttgtgctgctgaaagcaggagaggacaagagcatgaaagcaaggggagacctagctggcttttataacaaagccactctcacaataaataacccactcctacactgtctatattaatccattcataagagtagagcctacatgacctaactgcctctgattagaccctatctcctaacaatgttgcattggggataaagtttataacacaagaattttgtgggaggcattcaaactatagcactcactgatccgtgggttgaatggatactccttcatgctttcctagtcaagaggtcatgagagaattagcaaagctaagtagtgataggggatgggaagatgggggaattgaggaataattagaaactaaatgactctctacttttaccatttgattgtgttcagagagagagacctctgaaagaacagaatgtttttggctactgtataaattcttcccatatttgcttagcgtaaaataataggcaaagactctttatcctctcaaaattttaaaataaattattcacttctttaatacttaacataatagtgacgccaccctgtatctgtgggttctgcatcagtggattgaaccaactatgaatgataaatgttaggggaaaaaaattccacaaaatttcaagaagcaaaacctgactttgcagtgtgacaagtactatgttgaacccatgtgaataatgtgatgtgtaggctttggattaggtataataagtgatgtggcttgaccgtgtctccaccaaaaatctcatcttgaattgtcattgccatgatccccaactgtcaaggccggacccagctggagctaatgggatcatgggggccacagtttaccctatgctgttctcatgataatgagtgagatctcacgagatctgatggttttataagtgtctggcatttctcctgtttgccctcactccattccactgccctgtgaagaaggtgcctgcttctactttgccttccaccatgattgtaagtttcctgaggcctcctcagccatgcagaactgtgagtcaattaaacctcttttctttataaattacccagtcttgggtatgtctttatagcagtgtgagaacagactaatacaataatctggaaatgatttaaagtatacgagaaaatatgcataggttatatgcaaataatatgccactttatgtaagagacttgagcattcctggattttgttatccgtgggaggtcctggaaccaatctcccatggataacaaggggcaactgcacatgaaagtagatggattcttaatttatatatcttaattgcctttaacttttcaggatataattaataataggcatggaattttttttttttttttgagacagtgtctcgctctgtcacccaggctggagtgcagtggtgcaatcttggctcactgcaacctccacctctgggttcaagtgattatcctgcctcagcctcccgagtagctgagattgcactgtggtgcatgccaccatacctggctaatttttctatttttagtagagacggtgttttaccatgttggccaggctggtctcaaactcctaacctcaagtgatccacctgcctcagcctcccaaagtgctgggaatacaggcatgagccatcatgcccagcccaataggcacggaaattgttttgtattttattactattactgaaatatgcttcacatataaaattcaccatttttaaagcatgcagttcagtggtttctagtatattcacaaagctctacaattattaccactatctaattaacatatcattattcccccaacaaaccctgtactcatcagcagttactctccattactgcctccctacagtcccggatacacacatgtgcaagcataaactgctaattactttctatctctgtggacttgcttcttctggacatttcatataaatggaaccattcagtctgttgccttttgtttctggcttctttcacttaacatagagttttcaaggttcatccatgttatagcatgtatcagtacttcattcctttttatggctgaataatatgtcattatatggatatggcaggttttgtttatccattcctctgttgatagacagacgcattgtttccacctttttgctgatatagataatgctgctatgaacatgtatgtacaggttttggtatggacctttgcttataattctgttgagtatttctcaaggagaggaattgctaagtcatatggtaattctatatttaatcgtttgtgtaactgccagacttttctccatagcagtaattaagatgggaattttggaagaaaggagactgtaattggtcttcaggtatatttgacaatccttaatggctaaaagtggacagtggagcagtttataaacatttcaaaggtggaaagattgattatttaaggttagaaatggagagttttctgtggctggcctttcctagaacaagcatatgtcaatagggtctttttttgtggttgagttattataatggtctttattggaggaagctgccaaaacaggccgtttctaaacctataaaaggttttggagcaaaaaaatagtaaaacatgccaaaaatttaaaggttaaatagtatttcggttgttaggttgtattactgtatggtattgttgttaaaaggatgtcagtaattagtcctaaaatatttccagttgaaattttgttatacttttatgtctaggcattttagtttcatacaaaacttgttaaaatgtgctttttccctgatctgactagattctcaagtgggtgttttacgcatttggaatgtttcaagaacaacacctattgataatcttaaattaaagaaaacaggatttcactgcttacatgtacttaattctcctccaagaaaaaagtgtaagtaaaaatgttatcaaaattttaatttttaaaaaatattgtgttttctatcaaataaaatggtatagtgagatatcaaatactatatgccactgaaaagcaatttttaaaaaaggctttgacaatatatgtgctcaaggatccatcaaagctacacaagatctactgttactaaattgaaaatatttagagtcaagttacattttttaatgctactaagtaagaatatttagataatttcagattatctacatggaaaagatgaatcaatgatactgatgaaaataagttagaaatattaagagtgataggattaaataagattatctgaactgggagaatttatgttttaaacatggctcatttaaaatctgtacagtttacaacgaagttaaaacaacctaaatattcaaattataggatctagaatacatattacatatttgaataccagttgtcactaagttagtagttagtattatggatcttctgtgtcttctttatttctgtgtatattttctgtatcattcgttgcctctgtaattaagaaaaaataaaatacacttaatttataaaaaggaaaaatctggaaatttgggggaggtttagaattagaatttttttcaaatataagggaaaaataatagacttccagttaagtctatcatgattactctgcatggttggtagtgttcccattctgtataacacatcattaaaagcatggggaagggatttcagtgatgaaaagtttagagtgattgtttccttcttactctatctttataatataccaagtaattagcaatggctattcaaagtaatgttattttggtgtctaattggtaggcaatggcaagtagtagaaaatctctatatttgaacctataccccttgtacaaaattgtgaagtccctaataaatgtagaacctggaaactggagggtctagaaatattaggactagagaagtaatatgctggatgctggcttactgtttagggatgttggaatttttttgtcattgttagttcctttatttgtttagaagctttgaactgccatgtcatggaatgtctgaaataccagattcttttctttcattttttttcttactataaaagtagcccatgtccattagacaaagtcagaaaatacaaagaataacataccagtcttgtcattttcgagcaattcctttcagattacctcttctttgacttctaggttttcccttcaatttaatataacagaaagtatggaaaaagaacaattgtgaaaatgaaattttaaaaaataaacgtactcgctgaattctgaaaagcatgatttacaaatagattggtgcataaaagttgtctaacccacctataatgtcaattaaagtgttagaaaaaccaatgatggattatattaatttttaaacaaaatatcaacgaaatttagtgaaccaaattcattgctaccaaatgcctcttttgtcatttgtagttcattctagtttggactttctgtaattctcagattctgagaaatgaatattatccataataaatgaactaagaaaaattgtattttaatattaaaaatactgagaaatggccgggcgcggtggctcatgcctgtaatcccagcacttcgggaggccaaggcgggcagatcacaaggtcaggagatcgagaccatcctggctaacacagtgaaaccctgtctctactaaaaatacaaaaaaattagccgggcgtggtggcaggagcctgtagtcccagctactggggaggctgaggcaagagaatggcgtcaacctgggaggcggagcttgcagtgagccgagatcatgccacagcactccagcccgggcaacagagcgagactccgtctcaaaaaaaaaaaaaaaaaaactgagaaatattttccatattccagtgtacaattaataatcgattggtcttataatttactgtagtgtcattattttggattatgtttgcaagaaaatatttggattcacattctaaggaagagctttttggaagaagacaaaatatgggataaataatatataaaaataatcacagtgatatttatgtaattgaaagtaggagaaatccaagtctataaacagtaaaaagaaaaaacaaacaaaaaaacatctaggaagaaagaaaattgagatgccagtgcaggtcagatagtgttgtgattcttaatttatgataaattaaaatgaattatgcataatctcaaaaaaattattttcactggcttggaaattgttggcagagagttatttatattaaaagaaaaaattatatgcatatatgtttgtgtgtgtggaaggagggaataagctattatgtcagtattttgaaggaagtttataattcagaaataatcatgctgagctttaatttatagggtgataagaaaccacatattcacaacagattgtgattcctcaacacactaattttcatctatttgctccatctgtactttaaaataatatccaattttgtgcttatattacattttttggcaatcccaaagaactgcttatgtgggagaatatatgatcattgcctaaatggtttactggtacagattctggattttttttttaatgaagaatctttctaaattaagctctgtggtttcattccaataggattttttttcttctatttttagtttcagtccaatctccaaccaaaaatcattatacatcctcaacaagcgaagcagttccacccccaactttaacacagaatcaagcattttctcttcctcctggtcatgcagtgtgttgtttcttggatggtggagttggactttatgatatgggagctaagaagtgggattttcttagagacttggtatgtatgtagtcattcctttattatacataatagttttttgtgtaaacccatgatctttacttttacctgtctgaatattatttgaaattatttttgtaagtaataatatactagaaatttattgtagctggttgaaacattttagaaaatgcatagaatgatgataaaactactaaaataacttttaaccactatacttcaaaagtcttaatgtctacttatattttatgtacaatggaaaattacatagctgtagtatattttggaagcaaaatgagaatagaatgtcctttcaagagaaaggacaagttgatctctgccagttgctcaaagccttattgttcccatttgttaattgagtaacgttggattatgttttctaagatttgtttctattgttgaatcgctatgatacttaagtgattctatgaattctgtttttatgataattaagcccctatataagatagaatacaacctccttgagatcccacatttttgtctggttgtgttctgtggtacagccccactacctaatatagtatctgccacatagcaagactattaaattttgttgaatgaatgaatgaagacatgcaataatacatactgcgttgtaattaatatttgtcaaaaacaatcctctttaattttccctactttagagtttctaaaaatgtccctgtctttttccactggtttgaattagactaatctggacatttaagaaacctttaaatgctaattattttcctttgatcttagaaaaagaatctagagatgtaattgtccttgtaactgaagggagagaaagaatcaataatattgtatcttttcaagactgctcgtttaattttatcctcaaatgaaaaaatgatttatagcaaaaatatttttaaaataatctgtagcttaattatttttgaattttccttttgtagatattcatttgaagatgatttaattttcttttcactttaacttttctttttatataaactctttcctagtgtggtaaactttttgtatacttcaaattaccatttgttttcaaacaaatttatgaaagggaagggagaaaaacataagaatacacttaaatctataaaaaaaaactagtaagaacagcaggatatactgtttcctacacttgtttcactagaccaaccagaatgacttctgtagaattttgctgatatgtcctgagttgctttacatcagcactgggttgagtcactaaatctggcagtgggtcttcaacaagacaattcttcatttctgaataaaactgtgcttagctcaccaattcctaaaatcagttcaggagacaattacattgcagcaactcaaaagaaaaaagaaaaaatatactaacatgaatcacacatgccccaagtgccatatataccattcgaagaaaaaaaaaacaattttttatttttatttttttttttttaccacttcactatttaattacaagcaaagtcctctgtggttctccttggtctcctctctctaaaaaaaaaaaaaaaagaagaagaagaagaaaagagaaaggaaaatcacttccaccattaactcctaatctaaaaagtaaattctgccttaaataaaaatctgggtctttctactaagctaaaaaaaaaaaaaaaaaaaaaaaaaagttgtgttagtagaagagaagtcatgcaatctaaattcaataaattttctatgacacttcgtattaaagtatgttttacttaaaatctatgttaatttataattctaataaatgccgaatactaaatactaaaagccgcttgattataaattatttcagttgcttttctcactttaaaatgtctgccagtcagagggaggcagtcattttttccttatagtttcaattttcttaacacagatccaaatttgaaatttctcgaagtgttaccagaagaaacaactctgaactgctgtatgtatgaagcatctgcaaagattccagattacataggatgagaaaaatattattaatattttttaaaatcttacataattttaaaaatcttattaataaacattctaaaaggtgtacttccatatgaatatttgctccattaaaattaagaaaaatgccacaaaattttcctcgtcttactcaccttccttttggtaagaagaaaacacagaagaaacatttacaattttgttcttgctatgtgaattttcttatttcaaaaaataaaattttaaggcatagcagtgaaataacatttaaaactgcatgtaagtccctgcctggattatgttcctaacattggaaatgaccacataggacagcttcagccaggtgaaccagtggttctaacaacatttttacttcttgctaacccttgagatttttctttcctttacctccacctaaaggagaaactttacgagtacttttgtagtttcctaagggttgtgatttctggtattaatggaagtacacagagttttaaggactttcttctctacccttattctatttgttgaggactagaaaaccctgtctttgtacttcaactccgtctctagatcccaaatgttagtttcgtttgcttaaagtagaaatttcgattcccattccccagcatttagaatagttgtaattccggctatttatgttggactcttaacggattttcccaaaggcccacagtagttaagcactactttactggtgtatgtttacatgtatctgcatataccactttatagtcttgtgggtgtttgggatccaaatcattgtgtaatgggaacaagtattcaggttccaaagaatagacttgctagaaaattttggaacaaggctcattaacaattggggttatgcctgattcttctgtttctgccaaaattatgaggtgcttttggagtacgttattagtataaaaaaggaatatttgcattaaatgacttttagtttgagtttcatcttggtcttctattgtagtgccagatgacatatggtaactattaagagttaattgctttatagatttctagcatagtatcctgtaagtttaataaaaatagaaaatatcttttgcactgaattgaaactgaaaagtgagacttctgaacatctttgagtttagttgctgatttgaggaaccgtggttgactaaaatctaggtctgtacaaaataatacagtaatggcacagagaacattcaatcactgtagtgattccagttttctgtttttcttgcctatatatttttgcattaatatttggaaaaccgtatacatgtgtcaatttgagtaaacattgtggttcatctattaataatgtgaattttcctcaataattatgacttttttatgccatattcctagggacatgtggaaactatctttgactgcaaattcaaacctgacgatcctaatcttttagcaacagcttcatttgatggcactataaaagtctgggatataaacacattaacagcagtgtacacatccccgggtaatgaaggtgttatttattccctttcttgggctccaggtaagagatattttattgaaattaggaatacaatgaaatggctttttaaagttttattttcatttgagttactttcttcctcttgatctcatcttgttctaaatgaatgtagagcaaattagtgtgaacatatttgttgattctctttttgcgaggtttaagaagagtctatctgcagaggcactttgattcctggtttcctctatataacaagtcatgtagaaaaaccacagtaaatcaggattatctttacctgtctaatataagttgtatttctatagctatgcctttagaagtataatacaatttacatgatagaggttttctggaaagttttaatgtaaatcctgtttatggttatatatcaagtaacagttcacttgtaaccatgtaattctgtattaactccacctttgaagtattgaagaacttttatgccatcataagatcttatctctgatcttagatgccaccttataccttgctgtacatataaaggagagatgtcctatgaaacctctgacattttctcccaaaacattatttccccataacaaataatttcacacacctaaatgaatttttcacttttaaagtatatgtaatggtttacttatttggcttaatagtaatatattaattcaataactacatgtaatgtggatgtagctcatccttatttttaaaattatttcttcatacacagggattcttaactttgaatatttgggcctccaagggttttatatttcatcagagagtttgggaatctctgagaaatttatgaataatttttagtgtgtgtgtatatacgcctatatctgtcaaagagtatcttagtactcagattttcagagtttcatgatacgaaaaaggttaaggaccactgctttatgtatccttcatctcctacaatgaggagaattacagaaaaaggttttacttacaactcttaatgacaatgtttgtcctttaagcagaacataactgagcctattctgttgattattgcagtatgcacctccactgtaggttaccttggctagcaatataggaattggaccagccagtgcagtcaccttgcactagagctcatattagttgaatactcttcatcctacaaaagtatttgtctgaaacataaaacataaataaaacttatgactgtaaaaactattgtttcaaatcataacacagaagatctaatctgacttatagcattctttcactctctacattgagaatttgcatcaagaaagtaaaaatgttagaaaatggaaattctgtcattttctgttatgtgattactggtgcatcatgactttgaggtaagtggggatgatatttaaaagataaatgagggttgacaaggatggaagtagagtaggatatagataattacataatttcctctgtatcttagtgtagataccagacgaaaagaaaaaaaatgcaaataaattttgaaacatatccccaataatttaagaaccccaaaaggagagcagtttaaaaatgttagaaatatgatgagaacatttttagtgtgtataatcatttatcattaagtagtttcttcatatttttattcctagatagcagatgacagctgctcctttgttctgatggagaaaacctcttctatcactgtcttacaaaaggcacttatttaaatccttggccatctactactcacttagcagtagttttattttcacaaatttttttatttcttaaaacagaaagcattgtttatgtttttatggagaaactgtatttttcctgtgatctgttcatagaaatactttcataaccattaaaatactactagataatcatggaagtatgaatgctgactgaatatatgataatattgaagaattattgttaatattcatgatagtttggccttgatcaataaagaagtccctgtcttttagagatgcatactgaagtttttatggatgaaataatatgctgtcagagatttactccaaataaattcagcagatgctatagacagaacaagattggccctattttgataattgttgaagctgtgtaatggatacattaactttattattttatctataattttatacagttaataatttcaattataaaaaattaaagaactagtctgcaaatcacagttcttacattttcacaagttacattttttaaaagaattacatttgtgggaaacatttagtataatgtctaacaaattgtttcctaaggtggtttaaattgtattgctgggggaacttcccgaaatggtgcttttatttggaatgttcaaaagggcaaaattatacaacgatttaatgaggtaagatttatttattgctactgaataatataatgttttatactattttgtatttattttgtaaatatttttatttcttaatataatatcacttaataatcaggtggtatgtgtgttctctcaattagaagaaaatcctagagaatactcacatactaaaatgaattctgaaaattgtagctgagtcacctgaagttgcagtagagagtcaaaggaatttttgagtcatcctccacaaaatctgggcaaatacaaaataataggaagaagactaaactcagagcaagtcccaaattatagtcctggttctgttattaattagctcttgacataaggagaatcactttattgccctaaacctgtttcttcacctaaaaaatgttgaaggtggattatatagtttcttagattttcttccagttttcaaattcaattattccgtgcagagccttagaacctgctctcttgtatttgtagcatcacagattttatttctcctttgtcttggagttatattgtcatcccatattttactgagttccattaatatttgaaaaatacatatgatctgagtacaaaatattaggtatgaatcaggggaaaatgatctaagattgtctgtgtcttgaaatttcttttattttagatgattactattgaagcttattaagtatataatttctttgaaaattgcctatatatttggggttttaaaaacatttatacagagagtattatccctttgaagatgctccttagtagtcctgctcccccactacttgtagtagcgtagcaaatgcagagcttttaggaaaactttagagaccactgtgagcaattttgcactcaaaaaaggaaactttgacaaaggattataaaagttacatcctttcctttctctacatataacacaataccctttcagtttagcaatgccccaacctgccatcttccctcccatcaccaaaacaacaatttattccataataaatagtggattataagaagagatgagcctaaaaatgaaacttatggcccagattcaaaaattgtatatctttactcattagatcagttgatttcttcttatggcatcttggcaacttggaatctcacatatctgcccactagtacctaaacacttccagcctgattgtggaaacccagcattttagtatcaaggacatgtcttgtatttctttatgtctttcccaacattcactagcgaaattgcttaaatcctatgtcataaataagggaaaaattaacaatgccagcattaattaactaagctacgtgtgttccacaaaaagaattatgggatagtagagagtcataaatgcaattttcatgggaataaatgaagctgacagaaggcctccaccctataaactgaatgaataaaaggactagtcccatttttaaatctgcctgcataaacctaccctctttgatccccaaagaggtaaaacagcaaactggagattgctttaagaagttaaaactatatttacacagcaaccttaagctacaagataaaaagtcactttagtttcctcttaatggaatttaagtactatataaagtagaactgtttttaattaaaatttagaaatgggttgattacaacttttatttactgatcacaccgttgatgaatgacattctcatgtgtaatatattccttctagttttaaaaattcttataattccatctattaactatatcccctggcccttcctcagtcctagaaagcagaaaatcaagcaaatataaagtgatttattataggaataacatgaaatctattctgatttctttataaaatagaactttgaaacttagagaaacaaccaataataactgcttgcaacatttcttatactgtggttgaagtagcactgtgtttggaagcagatagataactgttttcatcaccatactggtactcatgggaaaaggcattaagcagagcttaattctacagatgacttaagaaggacattttgactctttaccttgtatccaacaaaaagaaatggagccacctgatttatgtcttaaaacaacagattggtatcttaaaacacttttaaattgtgacagctttagacatttttaaagtgtataatcaggtttctgctcttgacagtaatgcctctgttagtgtcatctaaagcacattcctaacagaaaagtaatacttagaagaagtaaatatataagagaaaaaaggggtgaattatttcttattgataggtattttacattttttgaagcatggaacaaatggaatattctgcattgcctggagtcataaagattctaaaagaatagcaacctgcagcagtgatggtttctggtaagtactatgtatgatacatgatatgaaattacactgtttataaagcactcatttgatcattccaactgtgtatccatgagatttcatttgtacagctctaccaactctcagaggcgttatttttaagcccatataggcacatactatattgctatgatgtatcattaataaataacaatgcaagggtatttaaaatttgtttaatgaggcattcaattgctttctcaatgaaaatactacttgaattattatgaaaagactcatttctttgcctcaaagaaactttaaggacttttcacagtcttaataattatcatcacattgtttggagagtagtattttggtttcacaggtgattcagcatatattaagtgccgtaaaaacttgtttatagttgtgtagatgcttttatttataaagggataaaaagcctttgcaaggagaaataaagtcatgcatgtgggaaatgccttttgttaggaaataacttcactgaccctgtgttttagaaatatgtgctttcttaattctgttaagttccagaaataagtaagttttcaaataaaaatatgtaaggaaaaaatgcctggtttaaaaaactttttaaaatcagatgctcctcccctgtagctgtctatgggtatagccatcttcgataggtggataggtggtatagacactcatagttcttgagaatacagaagttgttaggttttgctaaagccactccagtcttctcatcctcactttttaatttcagtagaaaagacagtagttatggaaaccaaagatccttaccgggaagttaaaattttcagaaacaacaatattagtgatttttttttccttgaaaggaactatgtgctaattgatagataccaaaatacaaaagtgcctaagagttttttgattaagtgatacaaaattagtttgaccatgtatttcaaggcattatatatttgacagatatcactttcagtgactaaacacctgtaagcataagtcaccatcaatccccagtaacctcaaaagtgttggtgggcctaataacatttaagacagtcttttccatacacttctaaaacttcataatacattaattagtacacgctttttttctgatggaatcaatagcttttgcactgtggtaataatagactaggatagtagagcttttatttttgcagttaaattatatagaatccttttcttatggcaggggatgggggatcatctctgaattttagttatattgctgagaatatacaatgaaaagttataacttaatgtcttggttttggtgcaatggtacataaaaccaacttcataaatagttgttttaaacactataaattttgaactacctcattttgaagctaaaaatctaatgtatatgttaattatatgattatgttttaaaatgtattacactatgttttcctcaatttaaaaaaattctataagaaaaagcgtttttgttgtttttccatcgctcaggctggagtgcagtggtgcaatcccagctcactgcaaccttcacctcctgggttcaagtgatcctcctgcctcagcctcctgagtagctgagaccacaggtgtgcaccaccacgcctggctactttttttgtattttttggtagagatggggtttcaccatgttggccaggctggtcttgaacccctgacctcaagtgatccacccgcctcgacctccccaagtgctgggattataggcatgagccaccgtgcccggccaagaaaatagtttttaaatcaaaatttattaccttatattaattgtaggttaccataattaatattaagagttgcaaatatacttataattggtaacatttatacagtactttcaaatgttctttttgctttgtagacaaaatctctatcctggaatatttctatttgaaatttacaattctgactttgtttccttgaataatgtatttagagtattgtttttctattaacatattataattaattctagtattattcgaacaattgatggtaaagtgctacacaaatataaacatccagctgcagtgtttggttgtgattggagccaaaacaataagtaagtggttttttttcctgaaataaataataactacattttggaaattttaaataaccataaagtttagtgctatttccaaaggtaatatctatcactctatttatacaatatcccctttgcctagcaaatgagaaacagccttgtaattgctcatttattttagttatttttattccatgaagtttttacatgatttacaaatattgatttcctactctcaaaaaaactttctaatacttaggaaaaaaaataatgctaactaatgaaaaatggaaatgagtccattgcatgtatggcttctatcatagaaatgtggccctttttttaatctcacttaggaatctgtgcaatgccagtgttccactgtgactttgcattgtcccccacccgatgctaatgcctctggcactgggtaattttccacgatgtggaacttaagtgcctggttttaaaaggtcaatcttgtttgacagccaagtatttatcatgtaaaaatcagcttagatttaaaattacatccaagtcaaatctccactaaaatcagacctttaactcattgcatttcctagaatattgtgtttcaagcctcttttaatgggatataaattatatctaaaaattcaaagttatttaagatattgtcaaaaacaatgtgaattatgttattttgtatgaaatgtgggaaatatagagtaaggtactaaagcctaattatacttgtgttcagagtcaaatcacacgttttacaaaatgatagacctatgtatttcctccatcaagtgcagaagaatgtgtaaaaaacactgttttttgtgggttttttgaggacggagtttcactcttgctgcccaggctagagtgcaatggcatgatctcggctcacggcaacctccgcctcccgggttcaagcgattctccagcctcagcctcctgagtagctgggattatgggcatgcgccaccacgcccagctaattttgtatttttagtagagacggggtttctccatgctggtcaggctggtctcgaattcccgacctcaggtgatccactcgccttggcctcccaaagtgctgggattacaggcgtgagccaccacgcccggccttacacgctgttaaggttatatgcaaaataagctcactatcagctcatccccagtatttcccatctcagtggccaatattgctaacaaggaaaactgctaaagccagaatccttagccttttcttttacacctttttatatctcactttctgttttcaatcagccaccaattcctgtaattttctctgtctaaatattcatcttggccaggtatggtggctcatgcctctaattcaagcacttcggaagctgaggccagagggtcacttgagctcaggagttcaataccagcctgggcaacatagtgagacttcgtctcttaaaaaaaaaaaaaaaatgaaaaatgaaaaaattagtcaaactggtggggcacacttgtagtcacagctcctcgggaggctgaggtgggaggatgggttgagcccaggaggtcgaggctgcagtaagccatgattgtgccactgcactgcagcctgggtgatagagccagaccctgtttcaaatttaaaagaaaaaaattataaatactcttttttttcctaaccatcaacttgccactaaaccaataacatttgggtttttttagagtcctgcagaaaccttctaagtcagttctacagtttacaccctttatcatcacctcctctctctctaccccacctctccatgttgcagtcagaatgaacatttaagacacagagctgagcacaccattctactgcttaaatctttcaatactttcccattaactgcaggataaaatgaaaacttttagcaagcactacaagaaggtccctgaataatctttttcctattttattaatctcattcccaggcttgctttcccttactccttgcatccagccacactcactttcagtttatggaactagccatctgattttcaccccaaggttcacttatactggcccccttacctaggattctgtttcccaccttacaccacacaccctacctgggtgggagatagataactgctatccatccttcagctttcagctcaaaaaccacagaaaagtattccttgacccccatatgaagtaagtttcccatataatatgcctttggagcacttaatataataaaattaaattttatttgttggctggttgcatattggctgtctcaccctctgaaatgtaagccctatgagatcgccaactacgttatctgtgttaaacagcatattcttagcaaaacactcagttgctgaccctcactgtgccttgaaaaaaggagatgttcaataaatatttgttaaatatgcaaatgaatagaattaccttgtatctgactaattagaacagttccatattcctatttctctgttttatagagttaataacccatttggccagttgaaataaaagctagatattaatataatatgtttagttagttaagaaagctatattttcaaatgacactggaagtcctttatatttaactattatgcttactaccaagcatatctaataaacttcatttttaattttagaaaccttttaaaatgttttaattgccgtattcatattccacttagtgtcttagtaggtaagtgaaccttgaacataccaaagtttatttataaggtatctctgactgtataatttagatatctttatgtgcattctttaaatctttatgatatcatttctgactttatgtatctgtatatacatatatataaaaatatactcatatatgcatgtaaatatatatatgcaaattatattttcccaaatgtagaaactgtcttgtttatcagtggatcttgagaagatgtaatctgcacatttgcagattggcatgccagtttgcaaactgccgtatttctacatgtgggcttaaataaatataagtattataacccatgtgacaaagtcaacagtttgaagttttgaaagggttttgatgacagttgtgatccacagtgtgtaactgcctttctttatgtttagcatgtggagactgtttataatgatggttagagtagatgttcctcaaatagactattctggcaggtccgtgatttccacaggtcttcctactactcataattcctttcctagcagtattccaagtttgatcatgaaggtacaagtagttgcttagcttattctcactattgtgagaatactgagcaaagaacattaaaagatcaaattctatttccaggggcttcatagttgtatcaaacagttaaagcatcttaaagaagggaagccatcaaaaaggaatggaaaactggactgtgacttcctgtccaatcagacaaccctggtctgcagggagcttttccagaaaactttcagtgagaatactgttgtttgtacccatgccacaaaaacaatctaacaaatgggctaaggcatgtaataataatttgcccaccagcaagtaagcaaatgtcatcactcaccatttgggatgcttcttaagacctaagtgttgcagaatgtaaagtttgagaaaaattcagaaaattatgagtctggtcatcttgaaaaagaacttatagaaatagaaataccattacctctgacctaaaataaataaaataaaaattcaaccagttaaaagaaaacacagaaagaaacacaccatactggtgcagtttctgtaaatgagcagtagcgtgattatacacgattttttacatatgtaagtttttagtctaacttcactaaggaagcaaaaattctacttttagaaattagaactatggtatacctttaattattagttatatatcatatttatcctatgtcaatattccattgatgatatttcagagacatgatagccactggctgtgaagacacaaatgttcgtgtttattatgtagccaccagctcagatcaaccattgaaagtatttagtgggcatacagcaaaagtgtttcatgttaaatggtctcctctgagagagggaattctttgcagtggttctgatgatgggtatgtatttttggattctaattttctagtccttaaaatcataagcttatattttcctagaaatgtacatatttataggagatatatagatatatacagagtctccctctgtcacccaggctggaatgcagtggcgtgatcgtggtttactgcaatctccacctcccaggttcaagtgattctcctgcctcagcctcccgagtagctgggaaccacagatttagtattgaatgattaagcattttcgttgaatttttggcataaatccaaatttaataagataaataattaggagatttctgtaggttatgacttgaaataagtcagaatggtagggaaatcagttatactgccgtactcatggcagaactcacagatgctgcgctgcagcctggagagcctcagacactcatttgcagtggggcctataaaagcctttcttgggtttgaccaaaaaacatgcattgggacttcaaagcctaactacctaacatgtcatgaaaggaaagacacctgttctagtggcccctacaataacagtaagttattttgatacaaatccctttaatgtattcttatttatgaaagtatatcaaatgtaaaatatttaaatgttagcatatataagaaattagcaacaaaatttttagattgtaatatactttgatatattgtcgtgtgcaagcttaagaggacaaagaagaaatgaaaaaaaaaattttttttttgagacagtctcactgtgtcgccaggctggagtgcagtggcatgatctcagctcactgcaatctctgcctcccgggttcaagctattctcctgcttcagcctccctagtagctgggactacaggtgtgcgccaccacgcccagctaatttttgtatttttggtacagacagggtttcaccatgttggccaggatggtctcgatctcttgacctcatgatccgcccgtctcagcctcccaaagtgctgggattacagacatgagcccctgcgcctggccgaaatgaaactttatataaagcagaaagggatatgccttaagaaataagaatacatcatttatctcctatatagtgcaaaatagtaatacttttgaagtactactattttgttgtcagtttggcatatatctgtgactaaaaaattattgtgaattgtctaagcaaaattagcagttggaggtcttaaattgattgtaagttaaattttaatttcagtaacatttgtacaatcaatagatacaagtaatttcacgaatccagttatatttaaattttttaacttgatctaagatttattctacactgaccaagcaacttatatcactgacaaaaacatgaaggaattatttgctgtattgattaaagcataaatatccagtgacatttcagataatacccatcatcatacatgttatacttttataatttacaaatcatcttaatatattaaattactgtatctgtattattagtcatattttccactttggttatagctgtttttggtatttcgttttaacaaagcaattttattcacatgtaactaaccggcacattgtgcacatgtaccctaaaacttaaagtataataataatttaaaaaactgtgaaataatatgtttactaccagtaatgagtaaaagtcaagaaggaaaatatgtttaaataagctagcactagcctagttaaatattcatttccatctactataaagaaaagtatgtgaggggatgaatttgttaattagcttgatttaattattccacattgtaagcatacatcaaaatatcacataaatatatacaattattattttttaaattaaaatgaagagaaccttatatcttgagacataaaatgcttctagataagctaacaaataattattatactctattaagaatatgttaatactctagatacattataacttgaatgttatcacacccataatattctgttttcagtaccgttcgaatctgggattatactcaggatgcttgcatcaatattcttaatggacacactgcacctgtgagaggattaatgtggaatactgagattccatatctgctcatatctggcagctgggactatactataaaagtatgggacactcgagaaggaacttgtgtggatactgtgtatgatcacggtgcagatgtatatggtagagtgtctttcattctttcatgtatttgttatattgacatactaatgatgcttataacttctgaggaatacagtatttttgaagaagttatacagtgttttattttacaataacatttttcacattagaaaatatacacgtttattattataataccagaatgtgcagaagaaaaagtcaacaaaaattatcagaagatgactattgttagcactgtgttgtctttctccccactgtctgcaggtgtgtctgtgtttctgtgtacacacaaacacacacacaatgcacacatattgcgatgggcatatatacatgtatggcttttgtttttctcccttccattgacatcactccagaggtaagttgtttaacaggaaatcagtaatagagtagataccacttatttaaccattcctctattcttggatgtttagtacaatgttttgttttttaatataatcccgtttttttaatataattaattggttatggaaaatcagattacttaccatttgcacatctcttcactctcattcttgtttgtatttattctcatccttaaactttgatgggagtaaatgggcagattaagaatccaaaaatgatttcttagaaaaagtaacctcaatctagatcaggttcagatccatatgcttgatcacaatggccttttagccaaggcaatgcgggactgagtgtgggagagaatcatatttgttgatattcgaattgaaaggtccccaactcttcatcttttaactagaacgtcatctgcccatccactaactcacagatactatgtatgctattggttttatagtatacttgttgctgcttaaccacacgaaatatacttttaacattttcatccatgaccatttgctttctaataatttttttcttttttctttctttcttttttttattattattttgtttttttgaaacagagtctcactctggctctgttgcccaggatggtgtacagtggcgcaaacacagctcacgtcaaccttcacctcccaggttcaagagatcctcccaccttagccttccaagtagctgggactacaatcacatgccaccacacccagctaatttctgtatttttggtagagatggtatttcatcatgttgcccaggccgatctcaaactcctgggctcaagggatccacccgcctcagactcccaggaaagtgctgggattacaggcgtgagccaccatttccagcctctaatggttattcaattttatattcatatttatagaatatataaaataatttattgcattcttatattattttcagccagtatattaaatgcagataggttgactgagaacctttcagttactcacaatatttcttcatagcttcaattctgtagaagttttatgaagcacatataaataaaaaatatttttcaatgttcactttacttaaaataggtttttattttcatcaggtttaacctgccatcccagtcgccccttcactatggcctcttgctcccgtgactctacagtgagactctggtcattaacagccttagtcactcctgtacaaataaatattctggcagacagatcttgggaagaaattattgggaacactggtatggaacatatacatgtattagagtttatttctaaataagttttatgagaaatcttttctcactgaattatgtctgttcttcagattatgctatagaaccaggcactcctcctctactgtgtggtaaagtgtcaagagatattagacaggaaatagaaaaactaactgctaattctcaagtgaaaaaactaagatggttctcagaatgtttatctgtaagtattacaggaattaaatgcgaatattttccctttagccaacatgaatcattacaactatttttattcacatatttacatgtaccattctaattcattgggtaactcttaccataatctgtgcactataagaaagcaaatgtaaaactagaaacaatacatgagataacatgtagttattttgttaatttttaaatttagatatgcctgcattataatatttttgaagatgcaaaatattatgaggtttttaattcactattccatatttattttttgtcaactctttagcctccaggtggcagtgacaatttatggaacttggttgctgtgataaaaggacaggatgatagcttacttcctcagaactactgcaaaggaataatgcacttgaaacatctgattaaatttagaacagtgagtaaaatatgcaaatatgatgtactcaagcaaattttttgccttttcactattaaaatgtaaaaatgattttaaaaatatatatgattagatcggtagatttaaataaatgaacactgaggagatccatcttgggtaaaatgaatcataaaagtgaattacttgagaacagattaagtcaatcatggttatcataggttgagtctcatgaaattccttcaaggtcactcggaactccttgaaatgctttatctttcccctattagcagatgactgtgacatgtggactattctaattttagtctcagagggcctaataggctgttctgggatatgttttataataaatgatcatattatagctcttaatgaatttcagtaaaaactactagttacctcatccctggggcaatctacagcactaacaacaaaacccattctggcaccagaaagaaaaaattgcttgtatattttctgaaatatgtatagttaatcgttagagcatggagacagttgtgccagagatgtggatctaatgctcataaagagcagttttttccatgaagaggaagttactttctttaatcgcaaactaaacacctaatgactgtaaccacaaaatctatttgacaggagaagagctaattaaagtaagccagtaactttttgtttttactagaggcctgtctgtactgttgtatattactttatcattaccttttatctgttctgtgtaactacaacacctggagagggttaagaacaatggggttcaatctctcccctcccgtgtcccacccccacacacaccccaaaatattatgtttagaaacgtatcacattttatagagaaaaatatttttaaatatttacttcccagagctatatgcttttgaagtatgtattcatgtaaagtttatatgatcatctgttatcatgaactcttgtaaaacaatttttttaaatttttaattattatggatgcataatagtttatggggtatatgtgatattttcacacaagcatacaatgagtattgatgaaatcagggtaattggggtatccatcacctcaagcatttatctttttttgtgtgttaggaacatttcaattccgctctattagttatttcaaaatatgcaacaaattattgtgacacatacaaaacaaaatatgtcaaatttttttaaattctattttctttttaaaaccagtctgaagctcaagaactaacaacagtcaagatgtctaaatttggtggtggtattggtgtacctgctaaagaggaaagactgaaggaagctgctgaaatccacttgagattaggacaaattcagagatactgtgaacttatggttgaacttggagaggtaatgtgctatgaaagtaaaactaatgagtttaacatagtagtctaaacgttaagaatatactcaattttaagtattaaaaataaaaagctcagcactttggaggccaaggtgggtggatcacttgagcccaggagttcgatactagcctgagcaacacggtaaaaccccacctctacaaaaatcacaaaaaattagacaggcatggtggtgtgcacttgggaagctaagatgagaggatcagttgagcccaggaggcagaggttgcagtgagctgtgatcgtaccactgcactccagcctgggctacagaaagagaccctatctcaaaaaaaaaaaaaaaaaaaagcctgagcgtggtggctcacgcctgtaatcccaacactttgggaggccaagtcgggtggatcacgaggtcaggagattaagatcatcctggccaacatggggaaaccttgtctctgctaaaatacagaaaaacaaaaacaaaactagccaggcgtgtggcacgcacctctagtcccagctacttgggaggctgaggcaggggaattgcctgaacctgggaggcagaggttgcagtgagccgagatcgtgccactgtactccagcctgggtaactccatctcaaaaaaaaaaaaaaaaaaaaaaaaaaagggaaagaaatgtaaataccctgcgtgctggctcacactttcacacctgtacctgtaaccctaccactttaggaggccaaggcggaaggatcacttgaggacaggagttcaagatcagcctagccaacatggagaaaccccgcctcttctaaaaatataaaaattagcccagcatggtggcgtattcctgtaatcccagctacttgggaggctgaggcaggagaactgcttgaacctgggaggcggaggttgcacggagccgagatcgcaccattgcactccagcctggcgacagagcaagactccatctcaaaaaaaaaaaaaggaagcttatttttttacagatctaattgattctctaccaatatgatattaagtgtagatgttaggagagtagttatcaaagtgttccaggacagcagcattggcatcactgggatccctatgcatgtctcacctcagacctacagaatcagaaactgcggggttggagcccagccatcttgtgttttcataagccctccatgttattctcttgcatgctgaagtttgagaactaccgccctaggctggaatcttaacttcttacaaacaaacaaaaaacgatgttggctaatttgttcacagtagaatccgcttgctaatactacttgtcataactaaatcccacactggccagaagaagggtttctgctgaatatcatctgataaaggatgatgattgtttaatggagggctaaatcaacaaaactgatctttacaaaaaggttaggatgaatttatgcttttgctaccctttagtagatgggtagtgactgcaatggaacacgggagaatggggcttctgtttcttgatcctgagtgttgattacatgggcatactcagtttgtgtaaacttattggacctttcccttttctgtatatgcattttagttcagtgaaaattcttcctttccctgcctcaccaaaacaaccgttagaatggcatggacttatctcatagcttatcatcttttaaaaagtttaagttagttaattgtgtagctacaaagcatgatatttagagtacttgtaaataatataaagtaaaactaagcaatatggttacattaaaataaatcaaaactaaatttagctcacctttttactttccatatacttcaagaaaaacaatgaattactgcttgaccccaaataataacatgtgccattttaaaatgttatcaaaaaggcattataaatttaaaagtatttaatttaggagcaatgtaaaaattttccttgtaaagtagtaaatatttaactaaaagttgcttttttaaacagcattactgcagagaagatctatcaaaagtcaaggagaaaaggaattaataaattttggtacaacagtgtaattctttagctttctgggttttatatttgattaaatataatttaaactgcctttaactcaaagcctatttcaatcaggtatctgtttgggaagcttaataattttattgttgtgcaggttcatcgatgtacttaatgatccatgaaactgtacaagttgttagaaatatgggtgtcctaaggcgggcacggtggcttatgcctgtaatcccagcactttgggaggctgaggcaggtggatcacctgaggtcgagagtttgagaacagccctgccaacatggtgaaaccctgtctctaccaaaaatacaaaaattagctgggcgtggtggcgggttcctgtagtcccagctactcaggaggctgaggcaggagaatcacttgaatccggcaggcggaggttgcagtgagccaagatcataccattgcactccagcctgggtgacaagagtgaaactccatctcaaaagaaaaaaagaaaaaagaaatatgggtgtccatagaatcgtttgtaatcatttcttaggaatgttgtttatttttttaagcttatctattagacatgtttctattgaaagagcttggtgaattcaaagttaatttaatctacattgcaacttctttcttctgttagagagagatttcccctgaaaacatattttaagataccttttaggtaacatgattttaaatacgtagtattaaaaattgcctgtttaaaatttaacgtattattttctggttaattaccaattttctagtgataattgcaatagaaccctagtgttttgaaaacccttaattaaaataaaattttgattcatgtagtgatatttcagaaaattttcctctcagttccactctagactggaatccaatgaaatctgtattttcatataacagtaacaatcagcctttattaaacaatgagcttcttcaatagaagtccaatttttaaatatgaagacaagtattatattatcagttaaatgaagaaatgacaataagtaaaatttattaaaatgagtaggaaaggataaaatagaaatagatggtatatttgttcatgtaagtagcagtgaaataaaaatgttaatattttgaacaccatggaacaaattactctggagttgtattagaatatgagtcaacatatttttcaaagtacatattttagttactatttcttttcttcccttcctttctctccctcagtctctccttccgtttttctctttctttctctcaggtttaggactggattttccctaaataatagaattttacatattttattttaaaatattttaatatgtagagacttcaaaaatttgtggaaaatggaattaaaagatagcaataaaaaataaatatttttctcaacttcttcaaactccatcaagttcaagatacttttgtaagtgatgagagcagccatttaatccttccctaaggaaccgaggggtacttggaatttaaccatgtcaatacaatcttttttactttgtttttttgtttatttgtttgtgttttttttttttttttggagacgaagtcttgctctgtggcccagactggagtgcagtgatgtgatcacaactcactgcagccttgaacccctgggctcaaacgatcctgtccactcagcctcccaagtagctagaactacaagtgtgcaccaccacatctgactaattaaaatatatatatatatatatatgttttggtagacatgagggtcttgctgtgttgcccaggctagtctcaaactcctagcctcaagcaatcctcccacctcagcctcccaaagcactggctttacagacatcagccaccatgcccagcttcttttatattattgacagaggtaaaattagtgctctttaaagattttttttaagactacggaacaaaaagaagtcagaaagtaccaaatcaggactcaagaactcaaatataaaaatactatattataaataccaatctattttttaagtgtcttaagaattacacagagcaaccaaaattaatatgctcctgccctttttgccttctattgtagtgggacaaagccctgtcaattgcaccaggagtctctgtgaaatactggaagaagttaatgcagaggtaaggcagagagagtccgtgttaaaacagatgttttaaaatcatgttagaatagaagcagtatataaatatggcagtagctcttgaaatttcttattcttatgttgtcttaaataacaattaaattttgtatctactgatacagtaaatgaaatgaatcagttacaagtaattttggtgttcttggatttgacttgacctctgatgaagatagcagaaggcaaatttccccatgtcagtggagagaaggacagatcagcaaacatactcactgattaataaattgctattgaaatataagtggcaagattttctgaaggttagcataggttcgtaaaatactattctattaattatctcaaaaattttctctgtaggcactaattcctgccatttcttcccatggatatgagggaggcactgatgataaagaagggtctgaccactgaggaaattaactaaacattcttgtttcagaatgcaataacccgacaagattttttctcaagtgggctagtttcctggggttgccgtaaaaaaaaaaaaaaaaattaccataaaatgggtggcctaaaacaacagaaatttattttctcacagttctggaggccagaagtctaaatcatgttgtcagcaaagttggtttctactggaggctctgagaaagaattagttccatgcttctctcttggtgtctggttgcgtgcagtccttggcatcttgtggctttttgacacgtcactccagtctctcctttatctgcacatggcattattccctgtgtgtctctgtgcccagatttcctcttcttataagtcatgagtcatattggattgaggtcctaccctaatccagtatgaccgcatattacttcaactaattacatcggctaagaccctatttccatatatggttacattcacaggtatcgtgggttaggacttcaacatattgttttgagggacacatttcaacctacaatgtatcattattctctgttctattttattctactctcttctatgctattcattcatttaacaaatatttattaatgcctactatatgccaatcactgtgctaatcttatagagtactatatattattatgtaattacctttcttctgacattaaaaacagaaatttggatttttcttttatgcaacaaggtttagtggcaaaaaatcaactgcttcttatagacacaagtaaaaatcaatcaaaggctaaacataaaattcagaaggattaacacatttgccatgggaaagtagactgttccctagcacctgctcccaacagtaagttaagcaacaggctgattgtagccctcagattttaggctccctctcctgagctttaagaatccccagtgctgtaagtccctgtaccctcacagcacaattgtgaatgttattgctctcaccgaatccttaagaaagtcaagttagcagaggatatttatttcacaaaatattatttcaatctcagcaaaaacttaatggatttccatttaagaccaaagtggagtcactccgtgttaatattgcagaataaaagtaaacatattttgtattctatgtgattattgacatattttattagcatctagtcatattaatatgctactacgttgctttctatgttaggtatctgtgagtttaaaatgtggtgtatcctcagataaattggaacaaaggaaacctgaccaagattggtgtatatgaactgagctataaagaatacataggacataaccaagtgaagaggctagaggaagcatcccaggcttaggaagcagagtacaggaactctgtgaaaggaggctgctgtagctggagtgcaggagccagggggaagtgatgccaagggaaagtgaaaaggtaggcccaagctggacattttagggccttgtaaacgtagtaagcttttttattgtttctttttcctaagaggaacacaagacattaaagggttttaattttaaatagggtagaaagtgatgtgatcaattcttcatttagaatatccgcacaagctaaaatatcaagaacagattagagaaggtcaatagcagacatgaggaggccagttagaaggcaattagaatagctgagtcaagagacagcagtagcgtggacgccatatgtagtgatgtggggactgagaaaagtagacaaatttgatatatctaggagttaaaagtaactggatttggtaatagagatgaggaaggtataacataatttttaggttttaggtttgaaaaactggatagaagctgttgctaatcactgggatttaaaaacaaacaactaaaacaacaacaacagcaaaaccattagaagaggatttgaatcaaatggcacgaagatcattagttctctttggacatgttgagcttgaagttccttgtgattttagtggcattgttcaatagccagtcttgattttgtagcccaaagaagaaatctggatcacatggaggttattgttgatcttagtaagagctgttttggtagaaagaaggagactgaagcaagattagaatagatttagtggggaaggaaaaggaggaggcaaatgggaatacacaaaactcttccaagtctatttcatttatctttgaaagccaactcctgattttctctgcctcttagccatgtagctgccagaaagtggtctctccacaactcctgcatttatgctttatagatccagccattcatccagattggcagtctctcaatcatagtttcaaatgcccagggaagtagattattatttctaaccagcttctttctaaacagctataacaagaaaatcaaagtcacatagtaaaaacatagctgttgaggaatacttcgatgactctatgaaattggagactgttaacagtgagctggcaaatatcatgaaaaatactttccattttcagcatgaaaaatatctgctacccctacccaaagattaaaaattgaattctggtttaatgtaaatgctagcataaattaaatagaccaggttatttttaaacaaaactgaggttaaacattgagggcagaattagctagggggttagtcattgagaaaatacctgagacgtagatgggaagatacacacacacatgcacacacacacacacacacacatacacacacacagatggagagagagagagagagagagaaagggagagagagagaaatgggtgcagagagacagagacagattacagaaacagacacatgtacacccttcacaatctctaagattaccatcccctttctcccttcacatgtctggaacattattttcctttaatcttcctcacttaaggcacttaagacattctacattttattgttaatatttatgtttctatattctccatcttagtgatttttaagctacttgagtttcaagcctctctattcattgttatgcttcctaaaacaattaaaattatctgtctttaacaatgtagatacccacatatttgcttaatccacctgatatcctatcacacgtaccttgtataaaacatatttttgaataaattaattgcccattttaataaactacattgattttaagatctaaaatgttcaggcatattttatgtcatgttctaaagacaaacaagtacctatagtatttattatttcatacaacttttatctgccttccacatgtaatttgattataaaatgtcttttttaaaagtggtatgccaaagggctttatgaaatctgctacaaattttagccatactttcagaaaatctcaattcacctaaaaaccttcaaaataatatattgtttaaaaaactgtccttattttattaggagagctgaccaattaatccaggaagataaggatgatgtcattccatactgcatagccattggtgatgtgaaaaagctagtccattttttcatgtcaagaggtcagcttaaagaagctctgcttgttgcacaggtaaaaccacagaactaccccagtcacatacatgaatgcttgagcatgtagaagggagaaggttgtgttgactggctcacccttacataattgacaaagtcataaagggcttggcttctgccctcctccctggccttctttctcaacatttgagaacatactattttctggtcacagcgcacttattttattttattatttatttatttttttgagatggagtcttgctctgtcacccaggctggagtgcaatggcacgatctcagctcaccacaacctccacctcccaggtttaagtgattctcctgcctcagcctcccgagtagctgggattacaggcacccgccaccatgcccagctaatatttgtatttgtagtggagatggggtttcaccatgttggccaggctggtctcaaactcctgacctcaggtgatcctcccgcctcaacctcccaaagttctgggattacaggcatgagccaccacacacagccgaacttattttagatctttaaacatacaagcatctctgaactctaaactttacacatgctgctgaatgttatacaccatgcatttgaacaacttagtaataattcacttgaagctttttttgctacacacaattaacatctcatttctcctcaaattctaagattatctccaaattatagtataaatttcaaacattatttaagtatactttgctcaaaatcatattctgaaatgtgtcaattatcaacaattagctaaagaataattcaacatttaattaaattctaggctgcttgtgaaggaaatatgcagcccttacatgtttccgtgcctaaaggagcttcatattctgatgatatctacaaggaagactttaatgagtgagtgatttatttgctctgggtccatatgttttatggttgtcttccctttaggaatttttgaagtctctataattcatccttctttgtatactgatgacttgactgcctcaaccgcattcctcaccatgatccagttccatacagcatttactcctagatgaacagggaaatttcaggcatggagactctgtttatacacattttatatagctttcagaaaagcaaaatgcattttactagagagattgaaagtaaggcacctaaacacttagaaactaatcaaacctattggagaggaccaatgatgaaaataagatagactgcttattaatgttttactctaaagttagtgtatgtaagttcacagtaacgtagtttataatcccatgaccccagtattggtatctagaataatgtttggtcctcttttaaagaagaaatcctgatagttattttaaaaaagaaatggaaatgagaatttttcagccttctaacctttttttaatccagtagtctgccttcccccatcctttctatttgctcctattattaagctagaaaataggatatttaaacttttaagacactcatcaagtagaagaggatcatgaaatgttaagcaaataatgtgttgggaataatgtattcttgcctggatctttactgccattctctgccatttctaaatttgacattttaaaaagctaacacatgctagctgtattttggataccacataaatttctcaaaatttcaatttgacctgtaattcttctacgcttaacttcccctgtggctgaatcataaattgtccaatgcagaatggtaagcttttaaaatcaggcttcttttctgacagttgtggggatagagggagatagaggcttatcagaccgtatacttgtaaagaccactttcctgatttattttttccaaaaacaagtctttaaagcaagcatgtcaaattaaattttatttggtctttttatcataccttttaaaaagtattagtttgcttttataatggaatacttgtgtttatatagaatacacatttttttctttctagactcctgcacaaagtcagtaaagaactggcagaatggtattttcaagatggtcgagcagtactagccgcatgttgccatcttgccatagataatattgaggtacgacatttaaaactggtttatgtgaatgaaaagttttttagatatgtcatggtgtttgagaggaaaagatatggtgactttctatgtgagatctggttttgcatgtcttcgaagcctgagtaattaagtaattacattcctaattagcacacataaactatgagctcttgttttaagcacacatagactatgagctcttgttttcttttatttctaccacaagacacatatttataacaaccttgttttaaacatttcaacatagatgagaagcgccagtgtagtaaagggaagaatcactggacgtagacacaaaatatctgagtcttttctcacacatactgactttgggcacgtcatttaaccctcagaatctcaaatgtcttcaattctaaaatgaaaatatgaatacctcccttacctatttcacatatatttgttaggattataagaaaaaatacaaatgaaagcacttatttttcagtatattattcacaagttatatttttaaggtactttccacttgagtcattaatttaataaggaaaatgttaattaaagatacagattctattgtgcatttatctttagatatatttgctttaggaaatgatagataactatataatcttaaagaagctcttaaaaatttacatttttttctgatatggagattgaaggacatattgagaatatcatagagtgttattaattaattacaaaaatagaaccaagggttctaaactcttcaattctgacctaaaaaaaatttctgtatgtctcattaataacttttccctctgaaaattgcaattacgcttacatagctactttataggaatattacagtcaatattttataagaataattgatttataggttaatactgctttatctgctttatgagcttggaggggaatgatgatcctacccagcttctatgcaactgaagaaattattttcttattgagcaagcttgctatggcatacctgattcgcggaaatgaactggagttggcagtctgtgtgggcacagtactaggagagtctgcagcaccagcaacccactatgccttagaattactggcgagaaagtgcatgatgatttcagtatggtaagaattttgaaattcaaagaataatttcatagtgatggaatacatttttaaaacattataaattccatttgataagatatgcattgggagaatataggatcaccttgtttataaaggataagattgtggaaggaaataatgatataacaatgtcataatgatgagaactatcatggttgtataatgaaatttgccatgatccattctgaagtagcccagttgtaattccgtagtgtttcaagcacttaaagtatcatgagacaacaaatgtgctcttcttaagatgatcagaacacatattcccacatgttaaaattccgcatatctacacttttttcttgtcagatcttgtgtcctattttaaatttgtacaataaagtcacttatataaagcaacaacaaaaaatggttttgctggacacttgaaacaggacacctcccccagactctggcaatacccaaagaaagagaccctgggaattacctggggtagcccggaaatccagggcaaagcaattccagctcatatctgcagagccctggccttaagtcaaacaatccattattatggaggctctattaggaaatatgggattccgtcattccttagatgtttattgaataaagattattttagatttttatcttttctttctctcaaatacttaggatctcaagaagtttctaaatgaatttgtttatcaggactatgacctttccccattgcaagtcccatgcacacacacaccaccctggaggtggagctatacagatgactataactattgaacaccacaggtggtaatgataataataaatactaattaacacttctatactgtttactctgtgccaagcacgattttaagtactttatatgtaaaaattcactaggttctatgtggtaggttttaattttcctgaggtcgcagtaagtggtagagccaagattcaaagctacataaatcagctctgaagtttgcattcttagctgtcagactacttggggtgagcatccctaatccaaaaatccaaaatccaaaatgctccaatatccaaaacctttcaggtgttgacctgacaatcataagtggaaaattccacatgaaagtacttaacacaaaaatttgtttaatgcacaaattattaaaaatattctataaattaccttcaggctgtgtggataaggtgtatatgaaacataaatacattttgtatttagacttgggtcccatcccttagatatcttattatgtatatgcaaatattctaaaatccaaaaaagtctgaaatctgaaacacctttggtcccaagcgtttcagatgagggatacccaacctgtaccactttcttatctgcagccaactcgggaaaagaacaacacttacattcttcttttttgtctgaatctgaaggttttatagtgaatcaggaatttcaaagttgttttaatttttacatatatcttacagtaatgtaagagctcccttcccccactaaaatgtagtagtaccctaccatcagtttcagacttcagtgtacttaatggtgactctcctctgagagtatctagttatctctctatcaagagctataatagtcaattacctagggacttgccttcgtctcaaagcatgaagcctaattgaaattatttattcatgaaggtggctgatttcatgctaaaagtcatcatcagatgaaaggggatttgtttttaaaaagtgaaggtaaaaagcagtaaaagggccaagcacagtggctcacgcctgtaatcccagcactttgtgaggccaaggtgggtggatcacctgaggtcaggagttcaagaccagcctggccaacatggtgaaaccccatctctaaaatacaaaaaaaaaaaaaacccattactaaaaatacaaaaataaaaaataaaaaaattagccaggcatggtggcaggcacctgtaataccatctacttgggagtctgaggcaggagaatcacttgaactcaggcgatggaggttgcagtcagccaagatcatgccactgcactccagcctgggcaacaagagtgaaacttcgtctcaaggaaaaaaaaaatttggcagcaaaagagaaatacagtatacagttgacccttgaacaatatgagggttaggggtgccaaccccccaagcagtccaaaatccatctatatcttctaactccctcaaaacttaactactaatagcctactcttgactggaagccttactgataacattaacagtcaattaacagatattttgtatcctttatgtattatatactgtattcttacaataaagtaaactggagaatagaaaatgttattaagaaaatcgtaaggaagagaaatcaatttactatgcattaagtggaagtgggtcatcataaaggtctttatctacatctgcttcctactgagcagttcaaactcataacatagtatgttacataatatgattaaacatttttcagttaactatatgtcttaattacttttaagaaaaaacaaacttcttccttgtaacgcccccatcccaacaattcttttttaatatatccatagatatgtgtaacagaaactaggaaacagtttaaatgtggtgctgattagctttactttcaggagaaagctgtaatcctcctggctattagtagagctgcacagattttttaaaagatagctacatcatttataaagatgtgcataatttttaagctataaacagcgctttttttacatttactgtaaaagtctgtttctttgtggtattcatcgtataatcatggtattcatatttaatattttcctttagctttccatgtgttggatacaggtattatctacttttatttaagaacacattcctttaaaatgtatatactcctttattttattatttgaatactatctctgtattaagaaatatttatcaactattttcacattattttatggtatgccaattcacgtgtaatttatagcacatgaaacctgactacaaagtaatgagaaaagttcctataatcactcatgattttatacttaaaagttgtacaataaatgaactgtgatttcctgcaataccaaataatagctaactcagctaagcagaatgaaatatctcttctgatagtgaaattttatattttagatcattcaattggtctatatcatttttatatgtacatttttccccatttgtgtactgaactctcaaaaaagagtgaatttgattaacattgaaggaaattagctggccttgctaaaatttcactgtatgaagatgtaattctacattaagaaagtcaaattttgtctatagttcaatgaagtttgaatagaattttagcacagctattttatacacagtaaaaacaaatgataatttctatattttcatggacgttatttaaaactatgaaattttgataagaggaaacacatgacatcattcatgcattttagcatgaacagctaaactactctaacttggaacctgcccaatgtaatagaaaatgtggcagtttggaaagatattatgtgtaatttttaatggctagaggaaaataatatgaaaaattattgtaatcttttatcaattctcttttgacattatctagaaaactatttattagtaaaatgatgagttatcaaaatattttatgtaaaaaacttcactaaagtttttcttattctaaaaacattaaagtaagcctaattgaaaatgttactgtcctgatagtttgtgacgtgtgtgtattttttacttttagtaaaactttggatttcacaccagagcttgccaattgtctttattcctattctatattcattatattcttaattaagcacctcttaagttttaaaaaagaattgatttacttaaatgactaatgtagattttactgacgttttcacaaagaagatgaagtgtagggttttactcccagaggccccagcacacagctttataaattcttatgtgaaatatctcctattctaatgtcacctcttctgtatggctatatatcaattttttaaaaacaatatcttggccgggcgcggtggctcacgcctgtaatcccagcactttgggaggccgaggcgggcggatcacgaggtcaggagatcgagaccatcctggctaacacggtgaaaccccgtctctactaaaaatacaaaaaattagccgggcgaggtggcgggcgcctgtagtcccagctactcgggaggctgaggcaggagaatggcgtgaaccccagggggcggagcctgcagtgagccgagattgcgccactgcactccagcctgggcgacagcgagactccgtctcaaaaaaaaaaaaaaaaaaaaaaaaaaaacaatatcttgaattattgaaagttaagtgttttctcagttatgatgtatgcatccatttactcctcacctagtgatttgaagaggattttacagaaaatattttaatataaatcttctaagtacataccattttatatttttaaaaccctcagttgctttagtccactgattggatctttaataagtaaataggccggtctcggtggctcatgcctgtaatcccaacacttcgggaggccaaggtgggtggatcacttgaagccaggagtttgagatcagcctggccaacatggtgaaaccctgtctctactaaaaatacaaaaattgcccgggcatggtggcacgtgcctgtaatcccagctactcaggaggctgaggcacaaaaattgcttgaacccaggaggcaaaggttgcagtgagctgagattgcaccactgcactccagcctgggcgacagagggaatgagactatgcctcaaaagaaaaaaaaagggaaataagaaaactatctttaatttccacttatcatgtaagaaatatgtgggatacccaaaattatgaacttaactcaatattctactggtttcactgatctggctgatacaatttatcaattttgacaagcataacaaaagttgacgagagttaactttcacaatgtttgctttataattcactccaaagaacatattcaaaactacttagattagagaattgttctgtaatgataaaattaattataagtatgttaagactcatgtatgtaaagtttagtttttaatatttaggaatttataaatacatttgttgttcatgacctttggtttgggtaatctgcatttacagtagtttcataattaagtaggctattaatactgtttgtgtaaattaaaaagcaagagtggtatattatatgaattgcccttctttgagatagttatgaatgttatttttaaatcttctcctcaatgaagtgtccccttttgttacgttaacaggaatttggcagctgatcttcttctgatgattcctgataatgaactacatttaataaaactctgtgctttctacccaggatgtactgaagagataaatgaccttcatgataaggtatgctgatgatgttaaatattctggtttggaatgcagtgctatgatttaattaattgtaggttcaagcaaatagagatgcatgcagagaaacaaatgtgtggtccctttggggtacctacaagtacaacaaaagtgttgtacaataggaagtaacatttactgaactgctatgtgcttggcactcttctaaatctttacatgtatttgtatcttcattctcataaaactttgaaaagcatgggataattatacaaagaaaactcagagaaggtaaggaatttgcccaaattagttagcggtggagtgagaatttcaacttcagcaagtctaactccaaatcccaagtgttttccactgtacactttgcatactgaagtatgttgtaggataaatttttaaaatagacaacttagaatccttaaaagaattaatgaaatataatgaaatttacatgcatttttccaaagtgctttaaaaatactcatctgcagaatataggaatctatgcatcaatattatatacaaaaacaaccaaaatgttcaataggaagattatttatattaaattacagtacttttctatatttcagtgctattaatccattaaaaatcatgaagctctatttttattggcatgatacatggctatgaaacagttaaatagaaagcagatcacaaaactatgcatatgccatatgattttggtttgaaaataaatgtgaatgtatgtatttatttatgtttatagcatatttaggaagatacagtttcttttaagaaaatgataagatataagtacaatattttctcatcttgaacttctaaaataatgaagtttttcacttatttgaaccgtgatttttttatccctagtgggtgagtatccctattcattaagcaacagatattttctgagtattgtattaatacagattggccaaaagtgtgtgtgaatgacaacgtgtgggtggatatgtgtatgtgaatgtgtttgtgttgagacgcggaaaatacttgtgaaaggataaatgtccgaaattaccagtgggttgtgagatgatgggatattttaactactttatacaccttgtagtctgtgaattattttttttaaaagctgtgctttgtttttttaacatgacaactaaaagctattttacattgaaattaaaatgcatatgaaagaaagtaggagttttttaattatacattaactggtagtgtttgaatgtacactaacagctatcctctgaggcagaaggtgcagatgttaatatcaagactcagagaggctaaatggcttgtctaagctttaagacttaaactaatgacctcacttattattttcagattttaaagatatttccataaatatatgctcttaattcaaataattttatttatatcatttaggacaactttaataagaaaaccacactagtaataggaaaaatttagtatatgtactatttttttattcctataaactttactaacattgttgtcaaatcaattattttttcttttttcttttttttttttttttgacatggaatttcactcttgttgcccaggctggagtgcaatggcacgagctcagatcagtgcaacctctgcctgctgggttcaagcgattctcctgccccaccctcccaagtagctgggattacaggcatgcaccatcacacccagctaattttgtattcttagtagagacagggtttcaccatgttggtcagcctagtctcaaactcctgacctcaggtgatccacccgcctcagcctcccaaagtgttggcattacaggcatgagccaccacgcctggccaaatcaattattttctagtgcaagctacacacagtagaagaatataggcagttagctaagaccgcttttaatgatagggctagaatattattcacctcgtcttttcatcacacattctaaaaggatataattagactttctgttcagacttcattaatatctttttagaaagactagtgagtatgtgtaaaagtgttaataactgaacaatttcacaagtacagatgctcctcgacttaccatggggttacaatgggtaaatctatcataagtcaaaaatattctacgtcaaaaatacgtttaacacacctgacctaccaaacatcatagcttaacctagccttccttaaacgtgctcagaacacttacattaggctacagttggacaaagtcatctaacacaaagcctatttcataataatatctcatgtaatttaatgaatactgtacaaaaagtgaaaaacagaatggtggtgtgggtactcacagtacagtttctactgaatgcatgttgcttttacactaccataaagtcaaaacataagttggggactgtctgtaacactaaaaactatatattcacatatgaggtacttatataacttttagaattttaaaataggataaaaattacaaggatgatcatctttttcttcttcttatagtctatttaaaaacgatatttaaatgggagtgatttcttatttcctctatgccatgagcatatatcaaggtgaagaacctatgtctctatctagccaagcacagtacctaccctatagtagttgctttgtaaataactggcatttcatgaataaggatggggaaacaatatcaaacgttatatatatgagagccccgttaattcagtttgttgtaatttgtttgagagagagattgagatgtaaaatgttcattttacctaatttttaaataagaaatttgaaatgattaaatgaatgtattaataaataaattgaaacaaaccatgaaactattttatccacattgtttagcaacaaacttgaacgtttaagcttcaacaattataaacacatcagaatttgatataaaaggtaacttaatgcttaatacattataaggaagcagaccaacttacttgagagaggatcagactctcagttttaacagaaaaagatttttttttaatgaggaatgtggctttttattttatagtaatgaaatttcatggatgaaaaaatctccatttcatggcatttcaaaatgtcaaagctaaaaacttttagagcttctacattttttgtgtctctgaaataaggttgctttgtttcaaaagccaagtgacgttaaattacagcgtagaggacatggaataatgcacaccctttatgtttggtgcatttaatgtcgtttttgcgccgttatggtcagtatattttttctaacataattaatttcatcatttgggtgctaaatggcatttttgggtactaactccagtatcacaatcaggacaatttacttctatttcttttattaggtatttgtgtgatggaaaactactaactcattaactaatatcccctcttactgtttttagatcttaaaggtatttccataaatatattctcttaattcaaataatttcatttacatctattttagataactttaataagaaaaccatactaggaaagctgaaagtattttgtacttacactattgcttttatccgtttgaattttagtaacattgttttcaaatcaattattttctagtgtaagctacccacagtggaagaatgtatgcagttagctgagacagcccgtgcagatgacaatatatttgaaactgtaaaatattacttgttaagtcaagaacctgaaaaagcccttcctattggtattagctttgttaaaggtaagtaattagttggtagtagaattttaaatatactcatttatttgatcgttgttttcatactgatgattgttttaattcatttttgcattgctataaagaaatacctgaggctgggtaatttataaagaaagtagatttattggctcatggttctgcaggctgtaccggaagcatggcactggtatctgctcagcttcaggtgaggcctcaggaaacttttagtcatggcagaaggtggtgcaggagcaggcatatcacttggtgagagcaggggcagagagaagggatgaagagagagaggaagggaggtgccacgctcttaaacactcagatctcgtgtggactcagaacaagaattcactcatcaccaaggggattgcactaagccattcatgaggaatccacctccataatccaaacacctccctactccaacattggggattacatttcaacatgagctctagagagaacgaacatccaaactatatcaatgatcaacttaaaatcaagaactagtcatcctaaatttaaaaaggagagtgatgctgatgtgaaatatggcatctcttctgattttatggtatggggacctgagagaggataaataggaaaatacttgtgatctagaaaataaagaggtaagtaggactgactgacagaaaattaattatataagttaaaaatggatgaataaattttgagactgttatttaatgaatcttccatctggtttaatttttccagaatacatcagtagctcagactggactttggataccatataccctgttcttgacctactgagctatattcgtactgaaaaattactcttgcatacgtgtactgagtgagtattttttctgcaaaatatataagtgaatctatttgataattttaaagtggctccattgtttttggtattcagatcgggaaataggattatcttggacaggtagctacacttgtagaaatattatatttttgtttgttatatattttttttctttgttttgagatgaggtcttgctctgtcgcccaggctggagtgcagtggcgtgatctcagctcactgcaagctccgcctcctgggttcacaccattctcctgcctcagcctcccgcgtagctggtactacaggcgcccgccaccatgcctggctaatttttgtatttttagtagagacggggttttaccatgttggccaggatggtctcgatctcctgacctcgtgatccacccacctcggcctcccaaagtgctgggattacaggcatgagccactgcgcctggccgtttgttatgtttttaagaaaaaaaatgtagaggtcaacttgaaacagagtattaaatattagtggtcccacttaataatatctagtatgtgtatgtttatatatgtacacacacatgcacacctggtttaaagaaagcaagttcaaagcttttggatctcaagtccttaagaaactcatggtcatatttgttaattatccattgtatgcaaagcaccatactgagcttgtgggaaagaagtaaaattgctggaaagtacaaaatagacatcatccctggattcaggtactattaaaagacattattatctatataactaaagccctcagagactcttgtataatttacaagagaggctttgggctctttttgttttaaagcctaaatggaaaaaatgatgcagcagcctgggagactggctaactccctcagcaagaatgcagaagacgttctttactgtgagtctacacggtattccaggactccctccacctgaccaaaggagctatttagggataaattacatgaagaaacagccaggaaatacagaacaacaagcaggcaacagtgaaatactatttaaatatgcttattttatagtctaattgatggtatagcataaatatctgaataggaattaagaactggtgaataattttccttaagtttagaaaattttctaaacatatattgctataaatgtcacctttcagaatatataaagtacatgaactgtgtatcagagtaatgttctatgcctcaaattgtggaatttataaaaataaatatattctcttttagagctcgaaatgagttgctgatattatgtggttacattggtgcattactggctatcagaagacagtaccaaagcattgttccagcactttatgagtacacaaggtaaaaaaggttttttcctccatcatgacattagagcaatttctcttgctaagatggatagtctctaagtggattatacaaagtatcaaatatattattacaagtatccatctatttactcagcgtgtgctttataataaagcagcacataaattagggatgcattgggctgtaaataataataatttgaatactagcttaaactcctaggatttattgatctttcatgtcaagacacttgagacaggctttctaaggcttttactgccgtgcagtgatttcttcaaggacctgatactcccttctttccactatgacattttttggattatttcctcttgcttgagtatcccatggttagaagatagatgctagccctccatgaattacgactacattctgagtaggaaagaggtaagagtgaaagagaccacaaaggactttctcctggcaagaccattttattcaggaaggaaagtcctccttagggttttatgcccacatctcactaaaagaaaataggaaactgaatattttagcttttcaatctctacagcagaaaaggcagagtaaagggagtttgtaagtagcaggttactattttaatattttatattcaggcataacctgttagccatactcctacattttataacaacttgtttaacttcagcccttgtacttaaaacttcttatactataaaataaaattcacggtgccttccataaaaaccttcttccaagtctagtagttagctaaatggcttagtaggtaaccattttaacaaatgcagagggtccgtggttaagcagtcttttatttgtttgtttgtttgtttgtttgtttgtttgtttttgagatggagtctctctctgtctcccaggctggagtgcagtggcacaatctcagcccactgcaacctccgcctcccaagttcacaccattctcctgcctcagcctcccgagtagctgggactacaggtgcccgccaccacgcccggctaattttttgtatttttctagtagagacggggtttcaccatgttagccaggatggtctcgatctcctgacctcgtgatctgcctgcctcggcctcccaaagtgctgggattacaggcgtgagccaccatgcccggccggttaagcagtttttctgagttcatatgtggcagaggattctaagagaaacaggttttctcattcctaacttctccctattgcgtaggtgaagcactagctgtcacctagtacaaataaggaataatatggaattaatactatcagcatgctcagggaaaaatctctttctacataggtagcataaccaaaattggaaagcaacatttaacagtattaaaagatattataggagcagtaggatatatcacatagatgtaaaataatgtttaatatgttcagctatatataatgataaaagtaaagagaaaaattcttaattaagcattaaattaatatcaaaaagaaaaagaacggtttttatttgcaagggcaggagagacttgagagaatgtgactaagtttagggaatgtgttagcttagaaagagaaattgataatttcctaatattaaagaatgtatcgtctctgacagttccatctttgttgtcttgctgcttataattattttcttgacccactaaatatgtgagtccccaaagtttcattctctcgtcctctgcttccctttttcctcctctccatcccactctcctcccacggctccactccctcccgtctcctttctatacggtgtccttcagaaacctcaccacttttcagcttcacctatcacctctatggaggtaactcagtgtcttatattcaggcatagcgtactcttcaaactcctatgtgtatattcagcagcttgctaaactccagcctaaagtcagtatgctcagaattcaaatcatctttcttctcaaatctccttctcccgtgttctctttctgtcattcaagattaaatgatcagggtcatggttaagtgttctctctcactgtggctattatttaacatcacttaacttgtccaaccattcttcatacattatgcagttcatttatttatccactcactcatttactcatccacccaatgtttattgaataactttgacttgccagggactgtgctaaatatacaggtgagcatatatacgcatatactagaaaatattctatatgtatattatatataacgtataatgtctgtatacagaaatatataaatctaaaatcacatttaaagtttgtttgctttttctgatatcttagtttttggtatcagatgttaatttccttttcacacgttcagtcagctattaaaacgtcgggaggtgtcagtacctttaaaaattgaatatctttctgaggaattggatgcatggagagcttgcacacagtccaccaacaggtgagcaaatatgatataaaaattggaatgcagaaggtatttgatgttatagacaaacttgttggaagtatgtgtggtctcattaattttagcagaataatgaatcttgatttgtttggcatatatgcagtaataatttacaataccgtacttttctgccatgtagtcctttgttttactataaattaagtctaaagggatttgtctccatcaataaaggggaactaaataatcatcagggataatttctaatctaaacatcaaaaattctgtgattcgacaaaatgaaattttgatatctgttgaaaatatagatcattagaagactctccgtatacacccccttctgattcacaaagaatgatttatgcaactttattaaagagactaaaagaagagtcactgaaaggaattattggaccagattatgtgactggatcaaatcttccaagtcattctgatattcacatttcttgtcttacgggattaaaaatccaggtaaagcctaacatcagacataacatgtgtatttcaccattttacatgtttactttttgaaatatcttaaaataagcctaatttggataaaagtaggtaatttaggactggggtccagtaaggaaatattacctctagtgcttccatagttagtacaagtggcctctttctgcctaaaataaattcaaatacaagcattgtactgactcttaccacagaagcaattcatgtaatatgtatacctgcatgaaagtttaaaccaggaggttttggtgagccgagatcgagccattgcactccagcctgggcaacaagagtgaaactccgtctcaaaaaaaaaaaaaaaaaaaaaaaaaaaaaaaaaaaaaaaaaaaaaagatcccacctcccaataatatacacagcttattgagcagattcttatgtatttctaatgtaatgtgaaaagtcacatttctaatgcttccatgctagcccaatgaagaaggcaggttttgtcatagccacccaaaataaatgaagtagctggatactgatgtaaaccttaactgtagcttagcttgccactgcaagctagtttagtctcaaaacataaccagtatcttccaaaagacaggacatatagttgtatacacctttattatccatttatgctcacaaatagagaaccaagtcaggaaattaaataacttttagtaaagagcaagaaacattatgaaatatttggagtatgtcatcattgccattctctgccctttgtataccatttctagtacgtggtaccttcaggtttctttcctccttttcttaaggtttcttttctccatctgaccttgacctaaaagacactatctaacctctctgtagccaaacctgcatccaggaaaagagctactaattatctcatatacactgaggcccacgtgactggtatagatggagtactgttctgccaggatatttctgtttcaacagaaagttgacgtgtttgggttataattgtgaaatttctagtgcctactaataggagctgtctactttacatactcctatgatgagctttccattatctagaaataatttgctaacaacaagttgtatcatttgaaatcagaccccaaactcaacagctttagaacctaattaagaaaacataatttgtattgcatcttgtgtttttgaaattatgcttttccttatcagagctaggtaatatagactgaaaacatttcacatttagttctttataactaccctggcatatatcataactgatgcaactaaattataaataagcaagaaaatcacatggctaaacatattttaaacgatatatacaatatagaacaatattcatcatcttctggagagcacatataaagtttctggcttaaataatttccccagctgtatcgacataggctacatgagtaaaatagtgaaatatatttaagcctattactagacatatatgcttttatagaataggtaaactttgtggcagttaccagattaacaaaacatatttgtcattggcattactattgtatttaaagaatttaaattgtaaacaattctattttaacagatattagggtataatgacataatgttaagacatttgaaaatgtttctatatttgggtccagctcaaaaaaactaattttctcatagtcttcatttttttattagctttgcctaaatattatgtttttttttattgcagtgattctctttctgaaagtttaaaaatactttgcaaatttataatctcatcttctctttcctcaactctcactgtgcagggccctgtgtttttccttgaagacgggaaatctgctatctccttgaatgatgctttgatgtgggcaaaggtgaatccattctcacctttagggactggaatacgactcaatccattctgatagaagatttttgtccatgcttgatttttttttttaaagaaaaactttcatgggttagcattaccttaatctttgttgctcaagtgccagaggttgggagaaggattgcaggttgggagaggtgggaaatagcagtgaattttagtcattaacttcaaaatatatatatatatataatttaaaggaaaaataggtgcctcctttataaacagtaatagctacgtttgggaaggaggaaacatttaaattataaaggactgaataatctaaaaagcatataaaagtttcacacagcataaaagataccaaaatatcatatggttgaaatattgaaacatattaaattgtgcaacacctagaatagtgctagacatacagtaagtacttaatggatatttgaatgattgaatatcttgaaatgttgaaatgtaaggtgtgcacagtgatcttcaacttaacaaacacttacgttctcctttataaaatgcatagtaaaccactaacgttagctgttttaataaaagttttcagttataagtttagtaaatattaataaatggatacacattcaaaatacttttaaaaaaaagaaaatgttaccagtttttttatctgaagtttaactgtcccattgtaaaggtgtaagttatataggcttgaaaaaaattggcgggtaaaaatcacaaaatgcagtcgaatatatatatgaaaacttgcattaggtgataaagtgactattttaagagattcagcatgcatggatattagttttgattaatgtgtacaataatttacacagtatactctagtcaatttatgttaactttatttaaaacacaatttatttggccgggcacggtggctcacacctgtaatctcagcactttggcaggccaaggcaggtggatcacctgaggtcaggagttcatgaccagcctggccagcatggtaaaaccctgtctccactaaaaatacaaaaattagccaggcatggtggcgggcacctgtaatcccagttacttgggaagctgaggcaggagaatcccttgaacctgggaggcagaggttccagtgagccaagatcgcaccactgcactccagcctgggcaacaaagagcgaaactctgtctcaaaaaacaaaccaacaaaaaccacaattgatttgatgaaaattagttttaagtaaatgtttgtaaatagatattggttgaatttttggatatattatgttgatttaacttttaaaatgttgtttaaaagtgtgaagctatgaaaagcctgataatgtgactacagatatttcagttggactagaattctgactttgaaacttattaaattaatgcatactggaagtactttgatactcaagttgtttcacaagatttataatatagatggttttgtttgactaaagaataatctcatataactagaatacttgtggcttttattatctttaaacttgttgcatttaaaatatttttaaaaccttcttaacaaaacttcttaaaactggaaaaaatatatattatgtatctatgtatcatatttatcacatgaccacttttgattccttaaaaagacattacaggcttaaattccattttattaaaaaaaaaaaattgcctgtaatcccagcacttcaggaggccgagatgggcagatcttgaggtcggtagatggagaccatcctggccaacatggtgaaaccctgtctctactaaaaatacaaaaattagctgggtgtggtggtgtgtacctgtagtcccagctacccaggaagctaaggcaggagaatcgcttgaatccaggaggcggaggttgcagtgagctgagatcgcactactgcactccagcctgggcgacagagcaagaccaccatctccaaaaattatatatataaaaataattaatattatagaagagaatatacacaactcagagatgcaatggataatataaaaagagtacctgagatgtatttttttaaactcttagagatatctgtaactcaaatttttcttaggtgaggaggattattaactggcacatatgtactaaaaacccctcacttaaaaatggcagtctcaatcctactgtcattctttttattttaaaataaataaataagcctatctttttgtgcttacatacttaaaaggatatcattaagtatataaacaatcattacttctgtatttttaatgaatgcaggaaaataatatttttatgtataaaagatgaagaaaaaattttgcaagtctttaagcacataaatacaacagaatagccacccaatttctgtctgaaatctaaattggatggatttgaccatcattctattatctttgatttctacaatgtctatatcttattacctataactattaatttttcatagaattataaatgtcatttgactatgtcaatctgtatatattgtaccttaatatgaaaaacaaattttttaattcataaaagtatttttattagatttcatatgcatgaaacccaagcaaattatatgaatttattttactatttgaaaatgttcatattaccaataatgtggacaaattactttgcaggtttaaatatgcctctgtaaaggaagagtctcattagacaatgatttttaaagcattggaaaaatattttgcctgtaaaagttagtaactaggtggttcacaaaattacaacatcaaaatagttacatcttgtgaaaatatatgatttttatgtcaatcaagacaaatgaaatatatatgtatgtgtatatatatacatgtatgtatgaaatatatatatgtgcgtgtgtgtgtgtatatatatatatatatatatatatttctatgaaattgtccagatgtgttcaggaacatgattgcattagagcaatgactgtattttgttgtccttataacatttatattatttcagttttaagtcaaaaggtattctgaatataataaaagcctcacaaattatttgtaaaatttagtagttcatatttagtatatcagtaatatagaagacatctttatagtcaactcttaattaatgcttattgtaccaaatctttgagatatttgtacataaatgaaatatgtactttcatgctaaaattatatatcatgactgtgctataatttggcatgtcattatctagatttatatgtatgtacgtatttcaggtccttgaaattttaataaatattacagttaaatcctgatatgacatagttaccggctaagatgagtagttgtttctttcccgagacaccattgaaagacaagtgtttctccataaatgcttggatcagagtcatcagaggtgtgaaagggctaagctgtccaactgagttgttaccctactcagtaacctaggaaaatcacttcattgaattgttccagaggctgattcttcactatagaaacactgactacagtataccccaaaattactataaaaatggagaaagtgcttactcattaatacaaatgctatgtcatagtagcttctattcccataagctactcgggaggctgaggcaggagaatagcgtgaacccgggaggcggagcttgcagtgagctgagattgcgccactgcactccagcctgggcaacagagcaagactaggtctcaaaaaccaaaaataaaaacaaaacaaaacaaaaaagaaaatgttttattcctatagcagctgctatagctcctagaaaatttcattgcttccttctgtcaaagattctttttgaagtaaatggtctaagatatgcctgtagtgttggcttctgttgcacaattcatcctcaagaaactcttgaggttacccactttgaccatcctgtatcttcatttacataatcactatgtaatgaagcctacagactatttcctattttccagtctctataggtccctcaggattcttgggaacttaccatagtcgggccatgagtgatgagctctttcaggagattgaacacagcaccaggaggacaaagaaacttattatttgactctacccaaaattaatcctcttctctggatctttttcatggctgagcttcagagacttgtttctcaaaccttttccaaaggaactatataggttaaaagttattctcataattttgtactttagattgtcccatgagagtgcaagacaacagatacattacttatagctgattaagatatgcatttgacctagatctcttacctcagataaaactggattttgaacacattcccagtaagttatctgtatcatccgggctttcttagtcttcttcaatattatctctctaaaaatgcaaaatttaacaaggaagtctctggaggtagaattgctaataaaacagtctgaactttcaaaaatgcagaaaatctggtaagtttaactgaaaattgacattagtaatattcatcttgggagtcaaatgagactattaatgagccagtatcaaacataaataataccagttgaaaattttccacatataaaacataaaattaccatgtatatataaaagattattaatttttcaggacatcagtctgcttttgtttcccttcagttaaaatatggggcatagcagcaaccagtgggaacttttaaattgaactaaatgtattgctaaacaccgaatcaaattccaagaaaaggatgattttctttccccacaacttgttttcaatagaagggacacctgtttttttttaatggtttaagttcaggctgttcttagagatgatcaagatgttctatgggccaaagtataataatcattcagaatacgatttaattaatgaatgtgatgtgtaactatataataggcaaagcagtaacctttaatttctaataaggaaagcatatgaaaaagtagattcaccattcctacaaaattatgagaaagaactctttattcatcatggtgaattatgtttatacctttaaaattatttttgctcattctgtactaatttatttaattttgtattttcaacaatgcctggcataggagtttaataaacaaattgaatggaaaagaaatgttctttaacacaattatggaaaagacaccactctatttattattgaaatacatccaatactaggtgattctgtttctttattatggctagagatggtggcatcacttcttcaaagccatttgacaggtgcttttcaaggtttcttgtccatgtttctgataggtttcatagcagagtaataagaatgttgtccagcttgcttcacatgtatttctctatgtgaactgccaccactacctatatttgctgggacatttaaataagcaaaattaaaatcaattcatggttactaaatattcatacaagcatcaacatgtctaatgtatcaaatatatgcagaatgattggcaagaggtcaagcacagttaatctaaatgcctggtaaacaagaatatttaaatcacgcattatagtactcatggattaaaaaaagtctgaatgtcagccacttccaaaagtcatcagcctaaaaatctccagggcttattttggtgcatctgatactgaatatgacccaactattcttagatattgcttcagaaagcagctgaggcaacagtagcacaattttatacttagatttgacaaacgtccatgattcataatacagtttatggagctctgattacactgaggcattccagctagccacccagactctgtaggtcactcagttctaatgggaggggccagtggcaactaagacatctatattccattggcccataattttgctagataactaaattttggtgaacaagtagaggaacttgagtgttataaaaagaaaaaagcaaaggtaacaacctaacttacaattaattttggcccccctgtttgataattagaagattttcaggtgaacagcctgtgatttcagtgccattatatgaaatcttagatggtaaaacagagttacgttcctacagtctagtgtttttgcttctcctccttccattaactatcaaactatggtagcagacctgaactatttactctactctcttatcagaaactgaaatgaagtcctttgaacaaatttagaaaaaattatttaacacttaatagttctcatccatataattaccaaagctgaatccacatcattcattaatttactatgtgcctagattaagagaatccaagtatattatctggaacaggattgagacaagtaaaaaaaataaatgtatgttcaccttcccatcctgatctaccttgtccaatgaaggcttccataaacccatctctttttccaaagagagcaagactattgagatgaaagtgaatcataaaagagcaaccagagaatcataaaaaagagcagtagagaataaaatgggaggagttatttatggccacttatacattattaaaattgtaaaagcaaaaattcattttacttggaatcctgatctgaagtaatgatagcatgtagtttttctaaaaactcatatgtgaaccttgaagattttcaaaaaagataacaaaaatgagaaatactctttagcaattcaaatatcagcaggcatcagtttttgtctctggcctatttgcatctctttcttatactggaaggaagccgtgctgtgactcattactactcttttctaccttttcactgcatgtccaaagcaggtgaccctgctctttccctttcccagtgaaattcagttaatcataaggggaacgaggcaagcaagttaaacacaaaaacaaaacttacctgcagtttcctttccatacctcctgatcccctcctcctatgctcaccctaccactgtggcttcacctccctccctgctggaactttcaccacaaatgtcaccaacagaagaaggttgaggcaggctgaaggagaggatatattcctagaatctaaaggtgaaactatggatgcattttattcatggaaacattgttatccacttccgttggattctattatgtttactatgcctcaggtggttgaagagttaaagggattttgatgggctggcctgatgtttggacattaaaaagtgtgctatgaggaacactagttctacaaggccaccaaacaaagcaaaaccaaatagtgatgtgtgatcaaatagagtttggaaaacacttcattctgcttctctcccctttaatatttacaatgcatattagcatattaaaggttctgagaaatcatggtttttttttgtttttttaaaaaaaggaacattggcactgctctcaaagactctatgtaaacaaataacttttatccccggcgaaatccctcaacacgtcaggaaacataatctgtagcagaagtccacacacattttctgtaaagggctggagagtacatattttaggctttgtggtagggttgccagataaaatataggacacctagttaaatttgaatttcagataaataatgaataatttttagtaaaagtgtgtcctaaatatgtcctcagaggtatttgttgcattgccctgtgtttttatttgctaaatctggcaactcaactttctagactagacagtcaccttggcaactactcaacccaactgttgaagggtcaaagcagccgtaagcaaggcataaaatgagcaggagtggctctgttccctgttatttatgagcacgggaacttgaatttcatagcatttttatgtgtcaggaattactatttttcttttgattttttttttaaccatgaaatcctagcagtttgggaggccgaggagggtggactgcctgagctcaggagttcaggaccagcctgggcaacacggtgaaaccccatctctactaaaatacaaaaaattagccaggcgtggcaccgtgcgttgtagtcccagctactcaggaggctgagtcaggagaatcgcttgaacccaggaggtggaagttgcagtgagccgagatcacaccactgcactccagcctgggtgacagagtgagactccgtctccaaaaaagaaaaaaagtaaaaactatttttaacttgtgaactatacaaaaacaggcaacaggctgaatttggaccatgggctacagtttcctgtagtataaatgctttctgaattaacagggtttaatcaagtgacttcttgtaatacaactgattgagaattcttagtatgcaagtatctatatctgtctcaggactgactgactcatcctctgactactgaagaactgagctttgaactctaatgagcctgacgtgtttccaactcacctatttaagcataaatcagaactcagtggatctgattgtagcaggctggggagggggcagcgacttagcagaccacatgttcccttcacttatcataaagaactgcataccagtgtaattggcagtgtaggactgaatgttgacctataccaacattttaactatttaaccgttttttaaaactttaattgaagaaagtcaagcaaaaaaaaatcaattttaagaagcaaagagttaaaacttacgtaaaacagggacaactcttcctcttttaacttttaaattatatctgcgcccagaggcttgggcaggaaggtgattgagagtaacttctcccactgttggtttcacatcaaaccattctataaaatatgaacacaaaagttatttcttaaaaagccataatggccattgtcaaaataagatgccataatttaaaaattaagtaaattatttaaatttctgtttatcatattcctgagtagtgtgaatacctaggttaatagtccctccccacattgctcacaatatatttaatacacaaaatagttactttaaaggtaatatatttatgttcctgttagtctttggtaagtttttattcaattataatgtatatacaaaaaggtaaacaaacagtaagtataattcactccaatgaatgtgtgagtgaatacacttagggtaccatcatccagatcaagaaatgatgtgttaccagtaccccaaagccccctcatgtctttccaagacagtattctaaaaggaaaatgctatcctgacttctatcattataggttagttttatgtatttttatatttgataaaatcatacagtatctttcattttgcacatatttgtgaattaaaattatttccatgtttcccatatttctttttaactaatcctgtaaactgaaatacttgagcaatttccttgtgcttctaaagatcacttcctcctctgcaactcatccttcactgaggcttgaagaagttgctaagttaattcctactcaccagtcatgctctgtcaacactaaacacaactctggccagtaacactgccagaactatagttatcacaattaattactttggccacaaatgagaaatgtttaaaatcagcagtctcaggaatcaagactggaaaaagagcactgctcaagaattggaagggtttagatgatctgtagttaaagaaaaaatgtgttcaaaagacaacagagatacaggttagttttctacaaagatagacttttaaacagaaaagtcaatgatgcctgatttgtggtgttaaaatataactggacagaactgaaatgctagacaacgaactgaaaggaggtgaaggggtggcagcgagggatcagtgtcatagtgttctaaggtccttgcagtttcaggaagagagtaaagattaattttagactaagataaatatgcatgctaaaatgtatagattagcactaaaaagagtagagatttaaaatgttcaaaattagtgggaaaaaaaatctttggaaaaaaacttagtccaaaagaagaaaagataggtaagatgaaaagaagaaacagaaaaagagaaaaaaaaaactcaaaatagtatgttagatatgaatacatataacaacgggcagtattaataaattcataacaataaatcactgtaaatgaaatagaaacaatacttcatagaagaacaaattttaggactttacaaagtatcaacactaattataaagcaataataattaagatgctgaagtgacacacatgtagacaaactggaatagaaggttcagaaacagacccatacatacatgcaaactgaaacatgagagggcattacaaataagtgggaaaagaacagactactcaaaacatgcagctgaggcaattggttcttcatatggattgcagatgaagtaacagtgtagcaggacaagccgcagacaaaacccctcagacaccaagttaaagaaggaagcagtttattcatccgggaacttcagcaagacccctgtctcaagagctgagctctctgagtgagcaattcctgtcccttttaagggctcacaactctaagggggtgcacgtgagagggtcctgattgattgagcaagcagcgggtacgtgactgggggctgcgtgcaccggtaattagaatggaacagaacaggacagggatcttcacagtgcttttctttacaatgtctataatctatagataacacaaccgattaggtcaggtgtcgatctttaactaccaggcccaggtcgcggcactgggctgtctgcctgtggatttcatttctgccttttagtttttacttcttctttctttggaggcaaaattgggcataagacgataggggggtggtctcctcccttaacagattacaggttttcactttaatcaatttaaactttaaaaggtttcactttaatcaatttaaatataggaggatatatttataatctcattatgggaacagtgttaactatgaagcttgtatttgattttcattcctgccataacaaattaccacaaatatcatgacttaaaacagccatttttatctcatggtacagaagtctgtgtcctctatttagagtctcacgaggctgaaagcaaggtattggcagggctgcattcctttctggaagttctggggatgaatcttctcccaggctcactcagctctttggcagaatgcagtttcttatgtttgcaggactcaggcccctgtttattgcctggctgtcagcccaaggtaattctttgctcctggaagctgcaccacataccttctcatgctttccatgttgtcccttgtagcaatagcaggttgagaccctatcacactccagatctcttacttctccttctcctacatgtgtcttgattccagctgaagaaagatctctgcttctaagggtttgtgtgattagatcaggtctgcctgaataagccagcaaacacaccctatcttggggtccataactttacatctgcaaagtctctttgcagatgtaaagtatcatattcacaggtttcagggattaggacatggatagcaggggggctcattctgcctactacagagtttcataaaatcaactaaacttaaaaatatatatgaatgaagtaaaaaataatatttaaatagtatgtataggtaaatgaaataaagaataatatataaatagtatgtatagatttttttttttttttttgagacagagtctcactttatcacccaggctggagtgcagtggcacaatctcggctcactgcaacctaagcctcctgggttcaagccattctcctgcttcagcctccccagtagctgggattacaggcacacgccaccatgcccagctaatttttgtgtttttagtagagacgggatttcaccatgttggtcaggctggtctcaaacttttgacctcgtgatccgcctgccttggcctcccaaagtgctgggattacaggcgtgagccaccgcacccggcctagatttctaagttaaggaaattataaacaaaggcagcaggatgatagttactcttggaagggaatgtggagaatgcagtccgaggacacaaaggggaaggtaaaggcattagtaatgttctatttcttaacctgtgtagggatatacaaatgtgttttcatcgttagtcatcttctttaaattgtacatatacattatatacgtgcatgtgtgataaatatcacagcaaaattttaatgtttaaaaacatgcaaaatgtttcaagataaaactcttctcattaataacctgaatcacgtctttattcatgaatttatgagtaaagccagagatgagaaaaatcaaggaagagaaaacaaaatataagagatggaagaatggacaagagtaaggaaggacaaaacctaaaatatccatctcacaattttaggagatgttaaaattggtgctttcctctctggctagaaaccagagagaaaatggttttcttcagaaaaagttcacaggggagagaaatcctaatgacctacatctgcctcttttcccgaatgtttgggtgccacagaaatgatgcggtctctagatgtctggaatcaagtgaaataaaatttcaatacatgagtggtatcctgagtaaactgccagaaaaacaaacaaaaacatgtagagtgaaagttcaattactctgccacctgccagtgactctggcaaatgcagatggcaaatgctttgtttgggtacttagagaatgatttcagtgatacgtctggaaagttgccatgattgccccaatctgctctaccatctacatccaaacaagcctactatggaaaggataacattgtccacactgtagaaagcatccacagtgaatcatagtaatccaggcttttcccaagggatgagtgtcctgcttaactcttaaactccttagttacttgatatatgaacttgtttcttgtgaaaggttacaagaatttttcatacacatatacgtttctaaaaagaagtgtctgtatactgtgttaacttatgccttcaccaaaaagattgatttataaaccactccaatgctaataaatcatttcactgctagcattaaagaagtaatttccctttaaaccagttacagaagatagcaaaatgggccagtgccgacatttctttcatctgtgctcaagaatagcctgatagagcttggaagaactcagctgtttcaaaggaaaacttacctggattcaattttctgcctaattttctttgcaacatatgtaaaaggatgaggaactccgctttaagttcattggtcagcatgttgggattgcttagtaattctgataacctaatgttatctttaatagacttcgaaactgtagacctggaaaccaggggtaaacgcatctggtagctatagtccgtgaaattcacaaagtcatcctggatacttttaattctggaaataaaaaataaaatactgttgacaagcaacattttagcaatgagttttatattatcaaaagtttcacattaaattgtgttactaggaaattacaaagaacttactctcgatgtgttaataaagtgtaaacctcttctatcaatatttcaggcactccagctttacaatgaattgttccatggattagttctttaggtaatttaaatttttttcttgccaggaactttaatagtagaaagaaaatgtttttatcataagaacttttataaaaatctccaagtactatgaattcactttaatctcccttttatttacctatgaagtaatttttgtgtttaacacgttagttattaaaagataatattcagcaggaaaaccaatcagtatatatcatgctaatggaaataattatgctcagtttcataggtgactcatgacataaacagttggaatttaataaactttgtaatacacaggaacaagctgccaactcagtatcacacagtcacacacatacacgtagagatccaggaaattagcatggcacactttaaaacaaacatcttaacagttaaaagtgtaaatgactgctaacgtaccttctccaactgtgcccagttatccaacttgacttttaaagaggtcccgttttcaaaggatgataattcaagttcccaggggtaatatatacagaatatttctgcaattaggaagccatttgaaaaatctctgatccgtggcaattaggaaatgaaataaagtgtagttaattatgcagtttgtattattttataattaatactagtctaatattccatactaaaagtatcttgtaaagtgagtgttgttggatcgttgctctaaggagaacctactgtggaattttgctaagattatctacgtttcaaaggctttggtgttcttttgatgaacccaaactgttaatttgtattgaatccgcatttcaagaagatccccaggtgattcatatgcactttaaaatttcagaggcatggttgtaagtaatactgaagacaaattagtaaactagtcccccgcttatctgcagttttgctttctgcagtttcagttaccttgggtcaatcacagtcggaaaatattaaatggaaaattcaagaaataatttgtaacttttaaattgtactctgttctgggcagtctgatgaaacctccctgcctgctctgtgttgcctaggatgtgagtcctccctttgtccagagtctccacgttgtagacatcagtcaccttttagtcatcagatcaactgtacagtgtggtgcgcttgtgtgcaaagtgcaagagcagtgatgctggtgattcagatatgccagagagaaaccataaaattattcctttaggtgaaaagatgaaagttcttgacttaatagaaagttgtaagaatggttacaatggtaggaatgaatcatattcctgaaatatgaagaaaaagaaattcttgatagtttcggcatcacacctcaaactgaaaaactttcagccacagtgtgtgataagtgcttagttaagatttttaaaaaggcattaaatttgtggatggaagacataaacagaaatgtgttctgacagagggttctgtagtatccacagttgccatccactggggatcttggaacctatgcctctctgataaggagagactactttaaaccagagttctgcaaaagattcattgcctttttatagaatttagtttgcattcccagagcaaatattagctgccagttacatacaaagtgcctacaattaagcagcaactttaaaaacttgttggtaactctcaaactagatgccatctccgacaaagggtaaactgatccttaccagtattttttttttttttttttttttttttttttgagacagagtcttaccctgccacctaggctggagtgcagcggcataatctcgactcacagcaacctccgcctcccgggttcaagcattctcctgcctgcagcctccccagtagctgggattacaggcacccgccaccacactgggctaattttttgtattttttagtagagacggggtttcaccgtgttggtcaggctgttactcaactcctgacctcaggtgatccgcctgcctcggctcccaaaatgctgggattacaggcatgagcaactgtgcccggccgtccttaccagtattaatgcccaatatcactaaagaaaaagctttgactattttaatatttttgtagtcaccaaagcattctatattgtccacaatttaatgattggttgattaattgaataaacaagatgtatcgtggtattttgttaaagccttgttccctaatagtgttttcgtgtgtgtacgtgggtgggggggtcttgatttgaaacataagccaggccagggtaggcaatctgaggcctggcaggcggcggaaagcaggcggggcgcccaccgggggggcctaggactggcttactcaagcacctgttgatgttcctggggaagaagctgagatccagaccctgaagccaacgcagaacggaacgagacaagcgggagctcttcggcgcatgcggatagaccagacacttcttaggcctccctcggatgggagctgctagctgtggcgaaagtgacggtgacttgtctagggctgccgcagtctgtgtcaaataccctttttcctggccggcggcagccatgacgctttctgggttgctgcggcaacagcagaaggcggggctgggccttattgctggcggcgcggtctcgtggggcggggcggagtcttatggggcgagacctcagcgcctgcgcaagcgccgcagcagccgcccgtacttccgctttactcagattttggaccgcggggccgggtatcgagggaggcaaagctggggtcccagtggtgtggctgcggtctggggagcgctttcagtctcagatttagttggcctcactgttaacctatttagagctttttttttcttatgtcatcgttcataagttttgtattttaaatattgttggtttctgcccagccaaaggcctattttcagtcgtctagtttgaggagtggtgtgagaagactccagaggccaaggacagtttttgtttgggaattggaagagatgggggaaaaaaatctttgaaatggaaatgaatgtccacaaaatttaacataactatttccttaattattgcattaagtatttgtaaacattaatatttgaaaacgatgtgtaggttagattttcacacttaattaaaatctcctagtaggcataattccttcattaattcaacaaatatgtattgagtccatattatgtgccacgcattcatctagtcacttgggatctatctgaacacaatgaaaacaactgcaaagttggcataggcaattataaatatgtaagcttaattattaaaatccattaaaaatttttacagccacagttttttgttttttgttttttgttttttgtttttttttgcttggcagggcacagtgggtcatgcctgtaatcccagcactttgggtggtggaggcgggaggatcgtttgagctcaggagttcaagaccagcctgggcaacacaaggtggagagactttcgctacaaaacaaacaaacaaacaaaatagctgggtgtggtggtgcacacctgtactctcaagtactccagatgctgaggtgggaggattgcttgagctcaggaacttgaggctgcagagagccaggtgacaggccctgtggatacatacacatggtaaaatatgggatagatcttgataatgatactatgtaatatttttaatgtttattcatatacatgcttattaataaagtaaaccagtgtattctgtatgtggttaaaaaagaaaaccaaaactgaagctatgtaagtgttttctgttaggctaaaaaagttttaatgaatgattcattcattctgtaaaccttttctgaggaactatcctggagtatgtgctagatctttaccatccaatatggtagccactagccacatgtggctatttaaacttaaatttaaataaactcagttccactggctacattttacctgctcaatagccatatgtagctagtggctgccatgttgggtaggacagacacagcactgttccatcactacaggaatttcgattggacagctctgtgcggcagatcatttataagagattcagagatagaaatatcagtgaaaagattacatacactgaaaagctctgccatggtaaaaatatgttagcaccagaaaggaagcaaatactttggcctgggagagtgtaagaagtcctctcaaaagagatgaccattaatttggatcttagaaggtggtattttaagctgatttttaagatgaaagctttgaatagccatttctactgtgaaaggaaattaaatcttgggaccccccccacctcccccaaatcactaagctaaagggaaaagtcaaagtgggaactgcttagggcaaacctgcctcctattctattcaaagtcaccgcttagctcactgagctaaatgcatacctgattgcctactctggaaaggctcatcagaaactcaacagaatgcaaccatttgtctcccatctacctatgacctggaagccccctccctgcttgagttgtcctgcctttgcttctagttgtcccaccttttccagaccaaatcaatgttcatcttccacatgtcgactgaagtctcatgtctccctaaaatgtataaaaccaaactgccctgaccaccttgggcacatgtcaggacctcctaaggctgtgtcacgggtgctcatcctcaaccttggcaaaataaactttctaaattaactgagacctgtctcagagtttctgggttcacactaccttttattagctatatgactttgggcaagttatttaacatttgtatttgtaaaatatggaaataaataggatacaccacagagctgtagagattaaataagtgaaatctataaagagcctaaaacaatgtgcagcacgtagtgctcagtaagcatagatgattgcttcaaaggtgatcttggaaatttatttggatgatgaaggggcaatctcacacagagtgactaatgggagcaattgcatagaaatatgaggggttttttaaatgagttttaggaaagaacagaacccattagggttagagaaagtgtttaggcattatcaaccaaagagacattgtcaaccaaaggtttagatgataatggctagagaggtaggttagatctataggttagggtttatttgtttttgtttttgagacagagtcatgctgttgcgcaggctggagtgcggtggcgtgctcagggctcactgcagccttgacctcctggactcaagtgaacctcccaccccagcctctcatctcagcctcccaagtagctgggactacaggtgcaaaccacaatgattggtcagtttttaaattttttataaagacgggtcttgaacttgtgggcttgaggaatcaatcctccagccttggccttccaaagtgcagcaattacaggcatgagccaccacgcccagctagattggggcttaattgtaaacagttttgctaaagagttggaaatcttcctgtaatcagtgtgccaattgttaagcaaatacatccctgttagaaacactcccttctctgttctcagttctgtgatgccggagttggaacgctgcggcattttctcctttgctgggtggatggtaaattctgccaatatggggagtgagagagtggccaggaggtggggagcagggatttgctatttctctgcttgctgttcaagcccctgtgtaaccatggcaacaaagcttcacctggccggggcaattggttccagtctccagtatggttggttggttggtttgtttgtttagcactcctggtgcaagtttcatcatattctctccgaggttttagcaaccaccaagaagtggccctccttggaagtctgagacccaattttactctcggacagctcatgtgagctcctgaagtattagcaccagctgtgtacgccccatcctcaagtctaagtcttgaggctcttaagcctccaactcttacgttcttataacttcaacttcttccctgggggtggtaattgcttcctgaagtgtctagctctgtgttaatttgatggtcccattttagtttttcggttcttcaacaccaccagttccttataaagccgatgcaggtttgaaccacaggatttggaactgcacgggcccactaatatgtggattttcttccacctctgccaaccccaagacagcaggaccaatccctcctcttcctccgtctcctcagcctactcagtgtgaagacaaggatgaagacctttctgacgatccacttccacttaatgaatagttaatatattttcgcttctttatgattttcttaataacattttcttttctctagcttactttattgtaagaatacagtacataatatatatcacacaaaatatgtgttaattgatgtttatgttattggtaagacttccaacagtaggctattaatagttatgtctttggggagtctacagttgggttttctaccatgcaggacgtcggtccccctaatcttaatgttgttcaaggatcagctgttaaaattcttgctgttgaatacctggaattagttctgttttcctgattggatgctgaatgacatattgcttggtacctggagtgaggtttttctctaccactagctcacctgcatctttctaaagtatctaaggaacttgcttcttcctgttcatgaggtcgactcagcaggatatcatcaatatagtggactagtgtgatgttctatgacatgttaagacactcaaaaatctctgccaatcttgtggcaaagagcaagaaaattgatctgaacctaaggcaatagcttgaatgtgtgctatagatcctgatagataaaagcaaactgcttttggtggttttcgcagactgttatggagaggaaaaagtacattccagattaacagcagaataacatttgctggggactgtagaaattcattccagtaaagacacttcaggccaggtgaggtggctcacacctataatttagccctttgggaggccgaggcgggtggatcatttgaggtcaggagtttgagaccagcctggccaacatggtgaaacccccttctctactaaaaatacaaaaattatccaagtgtggtggcatgcacctgtggtcccagctactcggaaggctgaggcaggagaattgcttgaacctggaaggtggaggttgcagtgagccaagatcatgccactgcactccagtctgggtgatagagtgagactccatctaaaaaataaaaataaaaaataaaaaataaaaaaaaagacacttccaatggaaaagcagctgtaattggagttaattaagtctacagtaatccacactcattcattaggattcctctaacctgcataagccaaacagactttacagctcacagcataggaagcagcgtgagctctgttcatgctagtacttcttgcccacaggtgtctcgggatgacgtgaagaggctgaggtggaagcctcacacaccatgggtttacatcacagctgaggaatcccaaccttagggaagcccagtcttttataatgggctgcaaggaaaactgccaaatctttgccctggagggaaacattgttcttacgatactggtcagtaaacaaacctgcagtctcctctgaaggaagatactatattttttaacactgttcactatatgaacatctttaaaaagatgttctgaaacaaaagctgccagggcatctgcttgcaagatgcacagaaatgcaaacaactcaaaatggatgggtataccaaaaagcattacaaatccatttccatttcctgatctttactccccgttttggttgcagcattgaactgcttctgtcttcatctgtatttaagcttaacttcttgaggagtctcatcatagagcaaaatagtatttcataattatcatcagactgtggtttttcagaagtggctatactgagaggctctggcccagattctaaggcactcctgatggaggaaataattttaacactcataccaactctgaacagtttttctaagttgaaaggcgtagcaataagaatgcagtacactaaacatatgaattgaaaatatggtcgatatttaggcaatcataactataaacttaaataagactacatctacttaaattactatttaaatattttatactcaatattggtatcaaattcttaaaaagcgactacaaggccaagtgcgatggctcacacctttaatcccagcatgttgggaggccgaggcaggaggaccacttgaacccaggagtttgaggctaacctaagcaacatagtgagacctccatctctacaaaaaattgaaaaaaagttaaccaggcatggtggtgcacacctgtagtctccgctacttgggagactaaggaaggaggatcgctatagcctgggaagttgagactgcagtgaaccataattgtgccactaaattccagctggggcaacatagtgagaccctgtctcaaaaaaaaaatgactacaagattcaatcatttacttaaatgtcttgatatctcagatattaaacttcatttttatttttgttttttagagacagggtctcgttctgtcacccaggctggagtacagtggcacaatcatatcatagttcattgtaaccttgaactcctgagttcaaacaatcctcctgcctcagcctcctgagtagctgggactacaggtgcataccaccatgcctggtaaattttgaaaattttctgtaaagacagggtctcactatgttgcccaggatggtcttatactcctagcctcaagccatcctcctgccttggcctcccaaagcactgggattaaaggtgtgagccatggcgcccagcccttaaactctgatttgactgattttgaagctaagtaatgtagagtcttggttgtttatctccacttaatgtaatttactctatcagattcaagccaggtgcatattagaagcattttcctcaataatgtattaaaaatgtatttggcaacttcatgtctctatctgtatagatgaaactgttgataatgttcactaatataattgtaacttcagctaaagatcaagtcggttacaattgataataactatagtgagctataatgtcactttacaaatgaaaactgataggaacagatatctttctctctctacaaatacacagagataaaattaaacctttctgattatactgtgagtttgtatagggatgaatctaagagctacaaagagacgaagtgatgggcaatatgtgaggccactggatcttgtataatgaccatagaaaattaaaacataggccgggcgcggtggctcatgcctgaaatcccagcactttgggaggccaaggggagcagatcacctgaggtcaggagttcgagaccagcctggccaacatagtgaaaccctgtttctactaaaaatacaaaaatcagctgggcgtggttcgggcatctgtaatctcagctactcagggggctgaggcaggagaattgcttgaactagggaggcagaggttacagtaagccgagatcgtgccattgcactccagcctgggtgacaagagtaagactcagtctcaaaaaaaaaaaaaaaaaaacgcaaaaaagttaaaacataaaaaaattaatatattagtcaaggcaagtaatcataactaaaacaaacaaactcagaaatctcagtggcttaacacgccatgggtttatctcttcctgacattgcccgcctactctggggcagtgaggaggggaattttccgcctgcaggaatctaggctggtgcagacagcactgcccagaacatgtggcctctgcagttgctgttttgaagggagatggaggatatacactggctcttaagtctcctaggctgcaggggacacatgtcacttccactcttgtccgtcatgaagtctcatcctacctgtgtgagagtcccaggaaagcagagggcacgtgggatatttagaaagtgtgggtgtgagtcatctcagctgtgattagaaacctctttttaaaagggggggggctcatccttttggatgtgcagcgtgtgaggagataagaaaaacttcctttagcttttccttgaaaattcaaccatacactcaacttgggggattctaggtaggaaatattttatcttcagtaactgcatttatttatacttttgctcttttctcgcctggtttgttaactcagaattttgatcgtatgtaactggaagaataaaggggttacattaaaaacacttcttgctaatgggaaggctgtcctcctaccttcagtcaatatagccgccaatcacagatgttgaatatcccacacagaaacgtagggggtccctttcacttccttacaagaccaggaaatgcaggaactgtggagtgaaaagaagaaataagatggaaaaatattcataacaccgcagtagaaagtatctgtttcttattggttatccattgttgaatcattcaaaaacatagtggcatcaatcaatcagcaacaaattttgtttctcacaatgatgtgggacagcatttgggctgaactcaggcagttctgctggttgtgcttgaggtccctcatgaggcttcacttctctgtgactcaacctgggctgcgccgtctaggagggtctcactcatatccttggcagatggtgctggctgttggtgggcttctcactccacatggtttctcatccctttttcacatggtggtctcaggcttccacaaggatgaaatcagaagctgcaaggtctcttgagggctagcctcgaaattaacccaacatcacgctactccatgtcttagtcacagaaagagacaggacccatccaaatgcaagacatgggtaacatgtccactcctcttgttgggaggagaaggcaagtgacattgcaaaagactgcacaggaggaattattgtcaatattttgcaagcaatctactcctgttcctctgtttccttcaagtcttaatggaatatgatttggtttgatgcaggtaattttcccacaaaggattcaagagagtagagggagaagttacattctcaaggagaaaagttagcttttttcttgctgctttttgccttccaagtgtgaccttttccctctagctgtgttaagtcccaggatagggtaaaggaattacctaagtcatttccatctgatttaacaaaagaggacaacttccctccagatggatgtcacgtaccagtgtatgagctggtgcatgcacaacagaataagactagctatgtaatttgtaaggcaaagtgcaaaatacaaatgtgggcttcttgaccaaaaattaagaatttcaaggtgatagcagatccgtaaaagcaagcatggggctcctcttagtgtggggccttgcagctgagtccccagctgaagtgttaataaagaggcatggaaaaaaagcatgttgatcatataatttgtcctatacaactcaagaagaaagtttgtgagatttaaaaaaataatccttttttttttttttttttgtttttttgttttttcagagagaatgtgactcaaagggtaaaattactgtctttcatttccttagacagggaccatttggctgacaattaaattgagttcttccttacaaggagtaatgttttaccttagccaatgtgtcattatgtacataatgaatatggttctacagaataatttgaaacataatgatgagaagtactgacttcactttgagagagatacctcaaaaattataaggtagttaggaaaatatttcttattgtcacactggcagggaggtcacaagccccaacagcttctgaatgtctaagtccaacccaggcttgcaggcctggtctctgaggtgtgcaagctgtgcaacctgggaggctcgttgcctagagggggtccatgcttggaaccagttatatagttggccccattcttcagtgatactgtaaatccacacttcctttaatacctgtctgcacacagcaaatatgtcctcagttgtttgcatatcaaaggaattaagtctgttctaatgaagtcactgaaagattactctacatttgtggctctcagtggggtaaatttggccccaagggacatttgacaatgtctagggacaccttgtttgtcacgactggagggagaggggacagggtggggtgctgacaacttgggggagggagcagattgctgatacctggtgggtgaaggccagggccgctgctggacatgcgacagtgcactggacagtctcacacaatgagaagtatctggttccaaatgtccataatgtggaggttgagatattctgttttagattaactcaaacttgcaaaagtgtactgctgagtgggagatggggactccaaggtgaggatggggctgtgagcagatggtgtggattcctgtgaagtctccaaggagaacacaatgaaaggaagagggcggccctcacatacctaaggatggaaggcgggggatgggcaggcaacgttagaactgagctccacagacacttatcccacctcgggaggtggagaaaggagaacagcatgtgcatttatggacagtgtgaactgtgataagcaaaggttgaaattatacacatagttgcagaccttatgaatattttacttcctgctattactaaccatcactgcagctagatgacagagttaatgcaaagctggccccgcttatcatgaacaggtcttaggagtaagctactctgttgaactataaagagtctcaaaaacatgctcccttccctcctgagatctgaaacaattctcagtaagacaaaagatcaaagcagttgggaaaaaaaaaaaccctcaaatctgtcactgatggagttgttatttgagaaggtgcttatgtccatgggcaagcatcttcctagtattcaactccaggtgtagaatgaagcctctcctagtcacaggcttgtgggacctggatgcaggcagaatcagctgctgtcaaatacatggttatagagaagcagaacagagcatttgttccctgtggcagctcagaccaggtagggagaggaaggggctatgcacgctcagttctccttccagttaaccaatcccattcagtggctccctctcttgtagggttggggactgctgcaggtggcagttatggaggatggggctgggggagtgaggacagagccctggagtaatgtgctagtgggggtccctacacatgggagagtaaaataggaacgggagaaagatgccatcctgcccgccttgcagacaggatcagtgtgcagtcagctactgcctttggagataggggacccagcatgatgaagctcctccttattatcatgagaacagaggagaatggggttgagggaggagcaactagaagaagaagaaatctttgccatatatggaactgctaaggtgcactgacttcattttcaaaactcctctttaatgaccaactgaagttaggggcccaaaagatgacgaatgatgtccagaaggctagcttcatccatttaggggaaagaagtgactaagaatccagcctaagcacaagtatgggagagggagagatggagtccctgcttccttccacagtatcccccagcacctccataaaacccaattctttctttttaaaagcctggtgtggttaattccatcttgtatatcggtaaagggagcttggaaaacactattttctccaagtctttattccctttgttctatcaggtatgcttacgccatgataaagcaagtttgaaggtctttcctgccgtatgatataccctgggctactcctgcagggaagcagccttgttcctcattcctctcatttcacatattctctccctacactactcatgttgaatatttttacagggtcctccctgtagaaacctgtcctgatatcgaatatcctgactgactacttcttctactctggatcaataagggatctcttttctgatcctctcgatcttctcctgtttgatgtcaagtcttatgcccaccaaaacccccatccttttcttccttgagtctttgggaatcttcattggttagttctctagcgtgctgttagtgttctggcacaaaaacactaatacctctggtttttaggaactggactgcatcagttttacttgccccctgtgggtagctcagatcaggtagggagaagaaggggctatgcatgctcccttcttccagttaaccaattccattcatccctcccctctgttgtgaggtgaggggtgctgcaggtggcagggatggaggacaaggactgggggagtgaggacagagcctggggatgctgtgcttgtggagctccctccatatggaagaagaaaaatggaagaaagttgctatcccacccaccttgtgattggaacgaatgtgcagccagtcacagcccttcatcatgcagcctgcatgaatccacttaggacagcaattccactggatgttttcttctgtatgtgtagggcatttatattctctaaagttctctcttgagcaattcctttgagaggatatcaaaagtaaagatcctgatatattggctttaaaaagttacactactgggctgggcatggtggctcacaccggtaatcccagcactttgtgaggccaaggtgggtggatcacctaagagcaagagatctagaccagcctggccaacatggcaaaagcccatctcttctaaaaaatacaaaaattagctgtacatcgtggcaggcacttgtaatcccagctactcaggaggctgagtcaggagaatcacttgaacccgggaggtggaggttgcagtgagcagagattgcacctttgcactccagcctgggagacagatcaagacccggtcttaaaaaaaaaaaaagttacatcactggcctgcaagagacagagattttagagctctgacctcaccagattcaagcttttaattgccttatctctggagctataaagataatgagtgttggcagtaagagtcacccttatttgcatcaactgcagaggcatagctgccagctcccttcctagggcacgcgattcacctcagtgcttacattccccatcaagacgcactttggctgcttggacttatgaaattccttttaaatattttaattagttactgtaaattgttctatataacccataaaaggaacctccatgacagagctcgtgaagcaggtaatgaatcccaaaatagtgtttgcacaatgggagcatgtcttccctctgggctattcctttagatatccatgaatttgcctttataggagggaccatgtgggattagcacaggagaaaagcattaatttccttcccaagataaatatttctgtaataggttatatcatgtttttattcctgctttctcccatctttagtacagatattttggacatgctaaaaatgaccatctacccaggcgtggtggctcactctgttcttagacctggttgtctagggtccagtctcacaaggacaatgacaatagagagattgagcctttctatctctgttgataattttttgctggcttaagaccagttaagcaggtgtatcttagcagatgtatctcagtcttccacgaggataaaattagaagcttcaaggtctcttgaggcctaggcttgaaattaacccaacatcacgctactccatgtcttagtcacagaaagagacaggacccatccaaatgcaagacatgggtaacgtgcccgctcctcttgttgggaggagaaggcaagtgacattgcaaaagactgcacgggaggaattattgtcaatatgttgcaagctatctactcctgttcctctgtttccttcaggccttaagggaatatgatttggtttgatgccactcactgcaacctccacctcctgaattcaagcagttcttctgcctcagcctcctgagtagctgggactacaggtgcgtgccaccacgcctggctaatttttgtatttgtactagagatggggtttcaccatgttggccaggatggtcttgatctcttgacctcgtgatctgcccgcctcggcttctcaaagtgctgggattacaagcataagccaccatgcctggccaattacttgtatattttagttatctctttttgtttcgtccagtagaaactcgctgatattctttatcataattggagggaattgggtgttatctgaatgaagtgccaaagagttcatgtttagtgctcatctcttcggatatcctgccagctctgaaagttccatgattctccatgattctgaaagttctgtgatcctcctacttctgctgctgtggcaattggcctcaggttgggctgcttcagacgggtggagggtcaggcaggtgaacaaggaaagtctttgaaaaatctgtccttagagacagcagttccactttctatgcctttggcatacatctgtggctctctgggtctctttctttctcatgcctccacaatcttattgttatggcatttccatttcatatcatttgttatgtctcatatctctctggtaagtgctttatgggatgtttaatttttcagcactttacatcagagcacctccttgtcccagcttgtctttcaaacccctgccacacaccacaagccacctgcctgcctgtcgtctgctcttgggggagatgcccaagcatctatgaagcgggtggtacatgattcacattgcacgtgctggacttggcagtggctgtaggtgtgacagatttttaagacatattttgttcagtaaagatgagtaacttttgggtggatttctttttattagtgtgtttgagaaagccggtcttgtctgattgtagaatttgggttgcattctaaccctaagtcccagattccacccattgtggaagggattgtcatctaacattgcccagtggagggggattgagggagagctcagtggtaactgtcccaaaggacctggatccgggttcctaactccacagatgtctccacgccaaataatagagccactctctttacccacgaagacttaacttcaatctttgcagtagggagactgatcaaggaagccaaagccgctgaattagtttaacatctcctttctcttgttcccactctaggagaaagggtgctatctttccgcatacaatcacacacatcccttgtgggcagagaagaaaataacttttgtgtttcaagctaattgaagaagcatgtgatggcctttaaggggaaggaaatgtagatgaatctttgactgatgaggagggagttgtgaacatgacacagttccacctacagtaaactcacagcctacgcaggaggcagacaagcaaataaaaatttgttctgtagtactagggatgtgattagaagaggcctgcacagggttccaaagagaatagatggatatgcaacccagactgggggatggtgaggaaggtttggctgggaggagggtgaggaaggtttcttggaagagtgattttttagctaattgttggtggtaatgcagcagttattaagacagaccatggagaaggatgtgttccaggcagagggaacagcatttgcagtggcaaggagggaaaatgagctctgggaggatctagtctgtgttttgactttcacattaggaactttccttctttctttctttcttcctttcttcccttaccttccctttctttctttctcttctttctttttcttctttttctcctgcttctttcctttctctttcgtttctttcttctttctttcctctttcttttctttctctcttatttatttattcattcgttctttcttctttcttgttctttctttctttctatttgagacagggtcttacgctgaagtgcagtgatgtggtcatagctcactgcagcctcaactcctgggctcaagtgatcctcctgcctcattcctcctgtgtagctgggactacaggtgcacaccacgcccagcaggagctttcttaaatcagtgcaaaagccctctgtgatctgtcacctaatcactgccccatatcacccgcctaactctcctgacacactcgagtctcccagaggacaagagcatatgcatgctcccaccagaaattggatttcacagacgtcttctggaatttagatgtcattccaggaagaaatggcacaggagttggggggggtggggggtggggtgggcagagctttgaattgactgaaaagtttacttgaagagactgagaaaacactgaattgactgagtttatccaggaatttcctgatttcacttggtgaaaaggaagcttggagtaaaaattaaattctgttcagaataatgaaacaaacttttttgcaaacctgaacatgtaatttataaaatttgtacatgcaatatgtttttcataaaccaaaaaataatttttaaaatgtatttgaactccctcacccttattaaaagactcaatgaaattgaacacagaactgaaaatgggaaggaaacctatatttaaaaaatgtgaaaactggctggatgcggtggctcatgcctgccatcccagcattttgggaggccaaggcaggtggattacttgaggtcaggagtccaagaccagcctggccaacatagtgaaaccctgtctctacaaaacatacaaaaagtagccaagtgtggtgacacacacctgtaatcccagctactcaggaggttgaggcaggacaatcgcttgaacccaagaggcagaggttgcagtgagctgagatttgagactctgtctcaaaaaaaaaaaaaagagaaaactgagacgcgttgtgggaagtcagggaccccaaatggagggactgactggagccgcagcagaggaacataaattgtgaagatttcatggacatttatcagttcccaaataatacttttataatttcttttgcctgtctttactttaatctcttaatcctgttatcttcataagctgagggtgtacgtcacctcaggaccactgtgataattgtgttaactgtacaaattgattgtaaaacatgtgtttgaacaaaatgagatcagtaccccttgaaaaagaacagaataacaacgatttttagggaacaagggaagacaactataaggtctgactgcctgcggggtcgggcaaaaagagccatatttttcttcttgcagagagcctataaacagatgagcaagtagggaagatatcgctaaattcttttcctagcaaggagtattaatattaataccctgggaaaggaatgcattcctgggaggaggtctataaatggccgctctgggaatgtctgtcttatgcagttgagataaggactgaaatacaccctggtctcctgcagtaccctcaagcttactagggtggggaaaacctctgccatggtaaatttgtggtcagactggttctctgctctcgaactctgttttctgttgtttaagatgtttatcatgacaatatgtgcaccactgaacacagaccctaatcagtagttctgcttttgccctttgccttgtgatctttgttagacccttatcagtagttctcctttttgccctttgaaacatgtgatctactccctgttcttacaccccctcccctcttgaaacccttaataaaaacttgctggtctgagactcaggcgagcatcacagtcctaccaatatgtgatgtcacccctggaggcccagctgtaaaattcctctctttgtagtgtctctctttattcctcagctggccgatacttatggaaaatagaaagaacctacattgaaatattggggcagattcccccaatagagacctacacagctgaaatgaaatgatttgcttaaggtcatggggcagatgaagagctagtaatgcactgaattttcttaataaattttcttccatcaatcttgaaactgtgagaaagttcagttaggtttttaagagaaagggctaaccttaaaataaagtaaattctaaatgataataagaataacagagaaactgaagtaaaaaagtgggaataatccaagggaaaggataatttttaagttattttgtagctggatcactagtcagttgagctcagtgctatgatggaacaaagaaaaccttctactctgaagaggcctttcttttctactacatatctatttactttctcagaaacaccaaatatatgctgtggttattaaaacaatagaatttaattacttttttaatccaaaaaaattgtttcaacagtgtctatctacagttattgttttactaaatttcttaaatcttatgtcacatagtaactattttgtttcttttactttgtgaaattttgtccttgaactttaatgtgtgtgtatacatatatgtatatatgtatattatatgtattaaatatcacatatattatatgtattatatgtcacatatatataaaatatgtcttggattagaaggtctttgaggtatctattttttattctgtgctactctatcttaatgctcatgattcagtgatttggaaactggtggtgaaaaaaattagtgcaactgagtcactccatgacttttcattataaaataaaataatgagacaaacacaaagtgttttattccaatgaataataatcacactttaatataataacaaacatacaatacattaaagttagaacactactttgataagacaatcatactcaagctaagatacaaggtacagacatactgaaattgtaaagtgaccattttaatgtttgatatttacttctcttattggcacaagactaataagatagatgggttgtattactcttaaaatctaagacttctcctctagctcagggaaaatactggtggaaacctgttttacccaaaagcagctttaatatctgtttaaccaggttattctataataagaactccattttaatgcacgttatccattacaaatgtgtgagatattctataaaacacatatttaaaggtccctatcctcatataaaacattgtttagtgaatatgctacagctttatttctatgtttgaaaatctcaacaaacgttttaaatcacaactgattttttttctttctgccaaaatgcaagcttagtgatctgggggtcacatacaatcataatttattttcccatagtctggaagttagccaagaagtcagaagaaaataagccctgggttgttgaaaatagtggtcaaaatatttactttatcaaaatttaataaatctataaaactcacccaaagttgcttttgttttacaaagagttgtacgttgattatcttatttctaaaatcataataggccctgaattacaaaacaggcataaaattttattaagttttttattgcactcaagtatagttaaagctgaagagaataaacgtagtatttacccttgcagaggactagcttagtaatatcttcttttatacaatactctcttgctattacttgcaaatacagtatactctaagcccttgttttgtgtaaaaagaattagaaacagtgcgattaagttctctatatacattttttaaggtctccaatgtgttaagtggcacccactctttaaaaactccacaatttgagtttttaatcttccatttttttatatccttggactgatgtgatgatccccggaatatgatccagggcctgtttgttaattagatatatagttcattttcttaagtccaagtatcactagctattgacaatttctgaaatggaagaaggctggagtaatatgcatataaccgccttgataagagatcatcaggggctactcctgagaaggaggcagtcttaacatagccttagaaggtgtgtaatgttctaaatatctcagggtgagagggcagtattgacctttcatcctatcacttttctgtaacaagtccatgtactatggagaagagaagtgacttgtgagtcctttgccaggggtaagtgggggagaggggggcaatttatctttatgaagtgttcattctaatgaccagtggacattcaacatagtggatttcctgaatgagcatcatcctggtttcagaaaacatattagttgctctttgctaagccatattcatattttatgtcaatatcagtaacaagttagccaattacaatagccaaaattaaaaagttaacccattagttgaagaacatagacctttttaaatataatatgaataactttactaggagctttatttctttccaatccaaaagaaaacataagatagtgactttattattttttcctgaataaacaggagggtatattgaaataacaaaaaatagatattataaatatgctataatccaaagacagcataaatgataaaacaatagtactaatacacttaaaatgaaaattgatattttactgcttccctgggtgatctcacactcacttttatcctatctttagcatatttttatatgaactattccttaagcaaaagaaatagaaattttgattttcaaggtatttagaattactttactgttttatcgatactgtaagaaattcttcagtaacgttggcagctggagttgtgggataaggtgcaatcttggttttcctatgtagcttcggatacagagtcggcaaagttggtaaagagagcttggggtagctacaagaagacatgaatctatttgttaattaaaatagaaatgaattttttatgttgtaaggtacataacataaaaccataaaaactacaatgctttgtagtaaacctaggatagcatgaccactatactagggaaatttatgtaagcagttatattgcttttatttataagatcttattataattgagatatattccatatacattccttaaaatattataatcctcaggcttaggaaataattgttgaatttaaagcctcagaaacaaagtctgctttttgaaggagatataaatcaaaagtcctgagaagtattatgcactaaaaggggaaattttaaaattaagtttaatatttaccctaaaagaaatattatagtccctggactaggattaagaaatcctattttagaacaaaagtctcaaatgtaaaaatatttactaattttatttctataatatgttatagaaggttcatgtccttataaaatggggcatgctccaaatataaatcagcagatattataccagaagtgcatataatgcattactgaaactaattgaatatatttaaccaaaaatatatgagagtttaggtaagatgaaagagaaaattaaaattatcattttttttcttttttttagatggagtctcactctgttgccaggttggagtgcagtggcgtaatcctggctcactgcaacctccgcctcccgggttcaagtgattctccttccgcagcctcctgagtagctgagattacaggcacgcaccaccatgcccagctaatttttgtgtttttagtagagacagggtttcaccatgttggccaggatggccttgatctcttgaccttgtgatccacccgccttggcctcccaaagtgctgggattacaggtgtgagccaccacactcggctgatatcttctttatagataaaacctaagttaaaaatcatctactttcacaaataatattccacattttatgccattgttactttccatgccaacaaaaactctctcactttcatctattttaggcaaatatattttgtttttgtaagtttccacatgtatttttcttaccttcatgttgaagcaatatcctttccaccatactgctagacgtagctacatctataggtcgcagaagctctgtatttttggcattgatatctgctccaaattctagcagtaagtttacaatttctgtgctggattgttgagcagcagcatgtaatggagtatcccaatatttgcctttctgtacgtcagcacctacatgtaatacggagtgaagataaatataaataaaagttgttaaataagccagctgcctcagtggggatagaaaaggaaaggcaatagaggaaggttattaaggggacttcaactctatttgttatgagttatttctttatatacatatacagtatctacatacacatatatgcctcatatgtacatatacatatatataaactgggcacatctgaatggcagagggtacatacatttgttatgtgactctctgatacttttctgtatgcttgaactatcataataaaattctttttaacttttaaatgattccaaaagtaaccatactaactactattataaagagtgcacaattaagttcactcatttttattttcatcatggttgatagcttttagaattattcaggtgcttatttctattattcttttcatttatttaaggcaatgaagctctttggttttcttgggaaactcatgaatatgtgagctatttaggtaaaatgtatatagattttcctgccatttctcacttatgtagtttaagtcagtaagtatataaagatattgagccttttaaatcaaaaggcacattgatgatatctgcatgaaaggaaagcttttaaaaatgcttatgttaaaatacagcctacatgctacattacctattgcacacttactttatcccagtgcaaagcctggcacatgctggtcattcaatgcatttgcaataaataaatgctgtttagtactgttaaaaataaccatcccattttctggtacataaacggttacaataccagaaatgtctaccaataaaaatgcataagttcttttcaactctgttttccgatactatctttaaaactaatgatgtcttcatgaagcagtacagttaaagtgtccctttatggcccttctgctcctttcaaatttcaataaatgtaatcattttcaatatttttaaaacaaatataaaatgtttcgtgaaaaaattatattccataacaaaatttccataaagaaagcataaactttgttggttatgtcaattttatggaagaaaagggtctgaaaataacaatcaatcaacaattactaacagtaatttctatatatatatatttgtatgatatataaatatatacatttgtatgatatataaatatatatatttgtatgatatataaatatatatatttgtatgatataaatatatatatatttgtatgatatataaatatatatatatttgtatgatatataaatatatatatatttgtatgatatataaatatatatatttgtatgatatatatatttgtatgatatataaatatatatttgtatgatatataaatatatatgtatgatatataaatatatatttgtatgatatataaatatatatatttgtatgatatataaatatatatatttgtatgatatataaatatatatatatttgtatgatatataaatatatatatttgtatgatatatatatttgtatgatatataaatatatatatttgtatgatatatatatttgtatgatatataaatatatatatttgtatgatatataaatatatatgtatgatatataaatatatatttgtatgatatataaatatatatatttgtatgatatataaatatatatatatttgtatgatatataaatatatatatatttgtatgatatatacatttgtatgatatataaatatatatatttgtatgatatataaatatatatatttgtatgatatataaatatatatatttgtatgatatataaatatatatgtatgatatataaatatatatttgtatgatatataaatatatatatttgtatgatatataaatatatatatttgtatgatatataaatatatatatttgtatgatatataaatatatatgtatgatatataaatatatatttgtatgatatataaatatatatatttgtatgatatataaatatatatgtatgatatataaatatatatttgtatgatatataaatatatatatttgtatgatatataaatatatatatatttgtatgatatataaatatatatatatatttgtatgatatatatatttgtatgatatataaatatatatttgtatgacatataaatatatatttgtatgacatataaatatatatatttgtatgacagataaatatatatatttgtatgatatataaatatatatgtatgatatataaatatatatttgtatgatatataaatatatatatttgtatgatatataaatatatatatttgtatgatatataaatatatatatttgtatgatatataaatatatatatttgtatgatatataaatatatatatttgtatgatatataaatatatatatgtatgatatataaatatatatatttgtatgatatataaatatatatatttgtatgatatataaatatatatatttgtatgatatataaatatatatatttgtatgatatataaatatatatatgtatgatatataaatatgtatatatttgtatgatatatatatatatatatatatatatatatatatatatatataggctggagtacagtggcacgatctcggctcactgttacctccacctcccgggttcaagttgcctcagcctctcgagcagctgggactacaggcacatgccaccatgcctagctaatttttgtatttttaatagagacagggtttcactatgttggccaggctggtctcaaactcctgacctcaagtgatccacttgcctaggccttccaaagtgctgggattacaggcccatatattttaaaacccagtataaaatgtttggtggaaagaataatatttctagcaaaggaatgaaaggctctaaagcaggggtgtccaatcgtttggtttcccttggccacactggaagaagaagaattgtcttgggccacacatataatacactaacactaatgatagctgatgagctaaaacaaacaaacaaaccaaaaacttataatgttttaagaaagtttatgaattttgattgggctgcattcaaagccatcctgggccgcatggggcccacaggccgcaggttggacaagcttgctagaaagcataaactctattgatcatacaaaattcatgggagggagaacatagccaaaaaataacaatctgtcaatgactattaacagaactcatgtctaagactgagtaggtgtaatgagaatgaaatagtagatgtagaccctgcttgcaagaagtttctcagctagctaagataatgtgagtagtgcataaaagggctactaaaaataaaggtcagcatttatcagggatcgaatgattctcataaacaataaatagcatagaactccatttactcattttatttatattctaaacatctatcagatgagaggatgagagagaggaacgacgctaaagaaaagagggatgggaaaaaaaggtatgatccaaatcgtaaggggactctgagtcctatggtaagtgggaccactatggcctcagtgggttaggaatgtttttcaggggactaaagctgaatttacttgaaacaaaccttgaggaattgatttgtttcaagtaagtggaaaagggcagtaagtcttttcaagtaagcaggacagaaagtacaaagtctagaaaagtgcatgagtttttaaggttagcagaagacgaggttgtccaagcagttactatcctgaaaatttcttttgatggatttgttccaagacatatacatacttggcaacatcatattcaatcttgaggatcctaattttatgataaaagtagagctttcagaatccattacatacccaaatgtctgctaatgcagtgcatgcaaaatatagagattatgtatctatctgtgagctaggaagccgacttatcaagaacgaggttcttttttattgcttatcaagaatgaggttcttttttattggttctctattcatgtgtgaaaatgcttaaaataagaacattttttagcaatgagatctaatttttaaagatgctcatttagagaaataaataactgcttgtgtgtatggacagaatggaagatgttttaaaggaaaataccagcataaagaagcttccagatgcaatggaattgctgtgacatacaagctacatagagaggagttcccaaatgaggaatttcttggtcaacatctatgccccaggatatcaggatgtcaagacattcatggtgacctgccaacacaaagtagaggagtttaacttaatgcccatccaccccacacacctcaccccaggcttcccttgtggtgtcattcattgaaagatcaacagagcactgcaggttgctaaagaaactttcttcccttgtcacttaatcccagaactaagttacctttactggcggcctcatgcgttggggatggaagacatgactccagctgggctttggcaccatactccagaagcagctctgcacagcttggactgccttgggagcatgcgttgaataacggagtcacgccatctatcgtgattgcatttacctaaaccaaaccaaaatatccaaacataagattcataagtcatacatgagtaaccgacttaggcattgtcaaaaggtatgtgatttgctaacagaaatacgtaggaaaatgtgcacattaaatatgacaaagtatactttgctcttatgcattaacaagaaaagctgtaaaacagacagaaatatgatatggcagataattcattggaatgggcataaaactagtggaaatcatgaaaaaatgcatgctcaaatggcaaataagatctaattcaatgattagatacttttcagtaagagtaaaaatgaagaaaaaagtgtaatgatgatgaagttgtaatgaagccacattgctagtttaaagtggtaaaattggtagttctatttctgagactttatttaaggaaaatcatccaaaagatgggcaaacgttatagacctaaagatgttcatcgattgctatttacagtcatgaaagcaggaaataacctacagaatagtctatattatgatgcagcatgctacccatttatgcaatgattggaaatcctttttagagtgcaataagaagactaaggaattcaagagctttatttttattctgctatttttgaaaactaccgagaatgaaggaaagaaaagtaaaatgagaactctgttggattccctccgtcagtagatgttaaatgattaatgttttgaaaggtacttacattagctcctgcttccagcagagttctggcacatgccacgtgatctccaaggcaggcttcgtgcaatggggtgacatggtctaaggttactgcatttacattataaccctaaatgtggcataattttgaaaggtgagcaaagagttatatacttaaaaaatcatctatatggatgtcactagagagtgatatattttagacatcaaagaatctcaggcaaacgagtttccagtttagcaggataggccagttcaaatgccatagggtcaatccgttgttcagactccttagccctattattgtggcaccctcatgtctggacccaataatgccttaagtatttggttcaatagattctggcacattttctttaaatgttgctttcttaatatttttttatccttattttgtactttgttctgtagaactaaacactcgttttgtagaactaaagacttgttgttttgtttttgtttttgttttgagatggagcctcactctgtcacccaagctggagtgcagtggcgcaatctcggctcactgcaagctccgcctcccgggttcatgccattctcctgcctcagcctcccgagtagctgggactacaggcgcccaccacaaggccgggctaatttttttgtatttttagtagacacggggttgcactgtgttagccaggatggtcttgatctcctgacctcgtgatccacccaccttggcctcccaaagtgctggaattacaggtgtgagccaccgcgcccggccaacttgttttgattgaggctataaaattataggtcagccaagaatgggagaaaaatactctaaactatagtaaacagttttgtgaacttttgtccctaaataggtatgatgaagttgtgcactagtggttaagaattctgactataaaatcaattagacttgggtttgaagtgtggctccatcacgaatagttttaatttggacaaataccttaacctctaaatttgaagattatcatgacaattaaatgagatcatgcatgtaaagcaattatcattataatgcccagcatatgaagacatcattttattgtaattattcaatcaaaactaagtaaacactttttcactgtattccaatcaaactcaaaatatcacactaaaataattaaatactattaggatgtgagattgtttgccttcttgatatctttggtatttcattgtctattgacaatcatactaagcactgtaacaggaagaacctcaaagccaaatcttcataacatattacagatcaccaaaatctgtaacaccaatatagacatgaagaatttttaaatgaaggcaagaaaacataatcctttcaaagattttgagttggctagccagcagtcagacctgggaagctaatcccacactgccacacactagagggaccagatgtcagaagcacctgagaaggccaagactccctttcacatcgggctctggggacagcctctcatgattcttggctgaactgtcagtggattagagacacacactgaaaaatgtcctaagactgctcttcttcaaagaaccacacggccctttctgaggaattaccctttagaatttgttgacccctttttagtgtttattttcctcccatcaagtgatgaacaaaacaaaacagtcacatggttatcacagaactggaaggccctaaggaagtgtctcactctacagatgagaaaaggaggctcaggtaggttgtgattcacctcaagtgccagcctaggatccaggtcttgagacccaggcaatgctttttaaattgggcaacatgacctttcctttcttcgtagccatctgagaatgttctttctccttgagactgggaaacagtagcgcatgacttccagatctggatgtgcatttgatttttttttttttttttttttttttttgagagggagtctcacttgctctgtcgcctaggctggagtgcaatggcgtgaacttggctcacggcaacctctgcctcccaggttcaattgattctcctgcctcagcctcccaagtagctgggactacaggtgcaagccaccatgcccggatcatttttgtagttttagtagagatggggtttcaccacgttggccaggctggtctcaaactcctgacctcaggtgatccacatgcctccgcctcccaaagtgttggaattacaggcgtgagccactgtgcccagctattttttttttaatttgtagtagagatggagtttcaccatgttggccaggctggtctcgaactcctgacctcaggtgatccacctgcctccgcctcccaaagtgctggaatcacaagcgtgagccattgtgccagcctagctgtgcatttgaattacatcagaagcttcaaaaaaaaaaatacccaagccaaagtgttttctgtttcaataaggatttgtgttttttatttttcctctggtgagtctgatgaacaggcaaatatagaaatgattgtcctgtagctttgttaggcaattgcccatagcatattacagatcaccacaatgttaaaaaagattgctttggcatctgaactggtgacttctttttggatatgttattattgaactaagtctgtaattagctgcacatattgtgcagagttaagcatatttagaaagctcaatcaataacacataaatccaatcattacttctttaaatgtctatcgatgaacaaatatgctgtctgagaaatctgaaatactaagacatacaattatatcaaaatatttataaaagaagtttcaaagataagtgagaaactattgacttctctgacatgagttaaaataaaagggcagaagtaaaatgtaagtggttttatcatatttgcattgattggttttgaccatgttctgtgcacatggaaagggggtatattttaaactatatgtaatatattacctgtgataataatgttctcagagcaagaaggcgaccttgacttgctgcttcatgtagtggtgatcgatctgcccaggaacctgtcaaaaaagaaaaaaagaaagaaaagaaaacaaaaatccaagagtcaaagtgaatcccagtagacacaatcaataccaagatcacataaattattcacactcagtgttcaacagggtgagccagatacttatactgtacattaggaaatttgactcttattgcaggaaccagataggcagttcccaacatgagccatgatgcatgctctggaattgacccaccccagacttactgtgcctttttaaattttttattttatttaatagatggagtctcgccctgttgcccaggctggagtgcagtggcatgatctcagctcagtacaacctctgtctcccatgtcaagagattatcccgcctcagtttctcgagtagcagggactacaggcgcacaccaccacgcccggatcatttttgtatttttagtagagacagggtttcaccatgttggccaggctggtcttgaagtcctgacctcaagtgatccacctgccttggtctcccaaagtgctgggattacaggcgtgagccactgcccccggcttactatgccttttgaattatctgcactcactattaaccctagtgactcactagcaacatttttcttccaaccattaccttgttgctgcatttattttggagattaagtatagcttaagaagatgcatataggtgccacgttgacaagggatggattagtgatggtaaatttcaggtgtcaacctgactgaattaaagaacacctagagaatgggtaaagcattgcttatgagtgtgtctgtgagggtgtttccagaggagattgtcttgtgagtaggtggctgagtagagagagctgcttgcagtatggatgggcaccatcatatggctgggggcctggagagaacaaaaaaacctctcctggtgttggaacactctcctcgagttgggacactctcctcctcctgcccttggacatcagaactccaggctttctctgaccttgagactctaggacttcagtggtcccctggattctcaggcctttgacctctgactgagaattatattggctttcctggttctgaggcttttgtacttggactgagccacgctacctcatcccagggtctccagcttgcagacagcctgttgagggacttctcagcctccatagtcatgtgagccaattcccctaatctcctctcatatagctgcgtctttctctgtctatgtatctaggtatctatctatttatcagctattggttctgtctctctggagaaccctgactaatacacctgacagagaaaaagagaattaaggccaccagatcagccacaaaaaagttctgtttcatgttttttcacattgaacccctcctctcaattttgttttgtccctttagcaggaatagcagcttgaatgcccacctcgccacactcccagctccttctgctatttcctgtggtccccccaccccagcttgcctgggctctgcggtgtaggggctgcaacatgttgccatggagggcaagtagctgagccccgcgtctgaagtgaagcatgagccctgcttctgcacccaagctctcctgaatgactcaacagtgtcctagtgcttaagcattctattgcctgttgctataaaacgggtatcaccattgtggtaaggaaagacttccaagacagctagttatctcccctgcagtaaaatcactctgcataaaccaaaaggcaaaacaaagaagacaatgagtggtcatggcagtcagggctaggagcatcagctctggagttagaccatatgactctctaaatcattacatttcatctagatttcatttcctctagttgaggatggaaataataattgtatatacctcaaggagatatgagaaactaaatcagatagtatacattgtgcttagactagtgtacacacatagtaaacaccattcaacattacctgctattaccattacttgtaagtcaacagagagaagagagactctgcctgctttcccttaggatttgtatttctgagaaaattctgtaatattaccagatacaaagggattgatgactggtaaatgacttctgccctctgcaccaggctggagtaacaacaatcttaacattgagaaaaaccaacttatttaatgataacctgattgcctaaataaaagcagagaacgcttacacagtcctcaccatatgcccatgtcctgccctggttgctgggcataaatttacttgttttatcctcaccctgatcctttgaggttggcgctattattatctctgttttccaggtgaggaaactgagacatgcagaagttaaataacttgcctaaggtcacacagctagaaaggggtggatgtaaaattcaaactgcagcctcctacctgcagtgacaacacttttcacttgttgagagatagcaatcctatctctcaatacacacacactctctctcatgcacagagtctgtgaaacattttagccagtggtaacagcatacatctctctgggacattttgttcctgtcattgatttcattactgtatttttccttctaacaccccctccaaaataaaacccttcagtctaaagagaagttttatttcattttattctcggcaaaagtaggctgttgcttgacaagataaagtttactgcaacaagatactatagcaatagtgcaggaatgttgtaatccatgctaaattgtaagtaaacaaattagggaggcaaaggctaactatgattcgaagttttagcaagatctttttaatttagtgggatgaaaattaaaagtacttttctcatattgggttctgtttcttagatagtcagggaatttctattgtctacacagtctttattaatcatctcttactattttaatatatagtctgtttcattctgattccctttcagcaaatttcttctgctccctgatgtcgagagaaaaaaagacaatgacagttaagtcttatcacatatttataagaagaaaagcaattccttgaatacgtccctgaaatgatagaactcccagccagtttcttgcatgggtgtttatcttgaattacagaataacgataattgaggtttacaattaaagacattacaactcccaaaagaagactaatgtatactttctctctcaataacagatataagtttccatctagtgttatttcttgcttatctagaaaaattagtaagccagacacataattcttttgagttttcatttgcaacaagttactgtgattagcttttatgtattacttctttctactgtgtgacagttctattatatattcaaggcagaattgcaataatgcacaccagcaaatattttttggtaggacaaaaattggtggcaaggtcataacttataggaaattggaacattgtgttatcattaggtaatatgcaaacgttatcatcataaataatgttcttttggggaaagcattttgccagttccggcttctaagatgaaatctgatgctttaaaaatcacaggcatctgtttgtatgatcattaaacaacatgattgcagaatgaaattctgcagaacttcacaacatatatcaattttttgtgaacacttaaatatttaagaaaatatgaaaattataatactaactttgcaaacagattgcatatgtgaagccactttgttcagttcaatcagcaaagcaataataaattaataaaaattttagtaatcaatgcctaaatgtgtttaaatttaaataaccacttataatatttataatgatcagtttccctcttgtataatagtatatttcattatccttaatttatctcttaaacacaggtgctgaactatatgatgccgacccattatccctgcctatttttccattgtcactagttaacaggaaaattaaccagatgttgttgggaatgtaaaggcctagagacgtggcctttgggattcattctggactcattcctttctagtataccatgatgacctttaaggggaagtaaagctaacaatatttgtagctgaagggtacttgatattccttccagccagctcttctcccttgcatactaatgtgtttgttcatcaaaatgattgtattagtcttctgaacaatttcagcattacttgctagggttgagagagagagagaaggacaggattatttagaaagcaggccacataagggacaaaataaagaaacataagtatccaaatcgcatccccctgtttccccccaggctgtcgcttagctttctgtccccactgccattttctttatcatccaaacttaagtccatcaagatggggacaggaaaaaaaaaaactgaagccagatattacgtatgtgcacttgctattatttctattaataggacctcctttggcatgaaaaagtttaatgtcattgtcattctcagaaacgagttttgaatgttggatgagggagcccttggcccatcttgcaggaacaaggcacatgctatcatttcatgaactgagctctgctcgcctgcaaagggccttgcaatctctcactattccttgaagaagggggtgggagtggagagcagaaggaggagaagaaaatagagagcaggaggaagtgagaaatgggatcgggtgtaggaaaaaagctgaggggctgggcaggcctggattggcaccccagctcaggacagtggcctttataaagtcatctaacctccctgaggttttgtttcctcatcaaatgagaaaagcacaatccatgaagcaggattgagggaggattagaaatgagaatgttaagtgcctgctctctaaatgcacaataaataataactagcattattggctaaacataagctggtaaatgggggagattttaagatgagttttagggaacaatcttttcccccaagatagggaaactaaagtaataaacaacatcatttattgactaaaatatttttgtgtgctgtcaccttaattaaatgacataaaacaattgagtgatttataaatatatataagccagcaaccaacaactgctgttatattttttctttctgaaataagaaatgaagctctatcaatctattaaagaagtaatttctagaacatgtataccactcaatgaaaaagaatctttttatttgttttgaactctgtatttatgtccctgttatttattttcttgtaatcccttagaagaatttatgtaattaatctaataacatatgagaatcaaaggatactacaatgtatatcacattccaatttctgtatgaactaagttttcacaccttgttcttccccttcaaaatccgaaatttagcaactacgtatttctattcaaacatatttaatattaaatatcttatctttcaatatcaatatgctttatatcagagagatttacgagccatctcaagaccaaacaagatataaatatctttatgtgcaactacttagtaattttataattgtgttagactttcattgagtgtctaagataaaagcaatgcaacccttactttaaaaaatgtgtaatttaactctttaggataaattattcagtgtgaaattgttttacaaagtgtctgtaactttcaccatgctaatcaaattcctagttattctctctctgtagctacacaggaggtggctctgcctatatttagaagcaactcttgttcccagacatctggtatataatttacagggagagagcctgccctgttttgtaaacaccacattgctagagaaaaacactcacatttttatatctatgcgattttgtaaggtttgataccatacctaaatcaccatctccccacggcacttcacaccagccactgtcgaggtaaatccgactcataatttttttttttttttatcagcaagaaaagaaaaaatcacttgtcatttgccagttctgttcggccattttaaggagctccaagctccttgtaatatgaccgtcggcctccaaaaagaaaaacagcttttgaaaaggtgatttatttccaaaattgctttttcttattgatcactcctctttatttgagaaactgctggtcctaacttatttttttctccttacagtatgtgccctgaattgaaataaaagcactacaattagacctctgtccatggccatggaaaaaccatattattgttataaatgtctttgtggccgggggtgggtggcttatgcctgtaaccccagctgctctggaggctgaggctgaaggatcatttgagcccaggagtttgagatcagcctgggcaacatagtgagaacttgtctctgcaaaaaaaaaaaaaaaaaaatgtaaattaaaaaaaattatctgggcatggtggcatgcccctgtaaatgccagctactagggaagtcctgagatgagaagatcgctagagcccgagtttgaggctgcagtgagctgtgttcccaatactgcactccagcttgggcaacagagtgagactctgtctcaaaacaaaacaaaacaaataaacaaaaaagtctttacctgctcccaatcttagaacatcccatcagcagaagcaggatgtggactcaatagagagctagcttagcaatggtgcagagtttagccacacctgctcttcctcagtgttctcaaaataggaaaattagggaattaattataaggagagggaataagcaatgacatttcatataacatgttcatttcagtaaaaaatggcaatacctttttcagatctcttacctattttatatatatatatatatactttttttttttgagttggagttttgctcttgtcacccaggctgtagtgcaatggtgcgatctcggctcactgcaacctccacctcccaggttccagtgattcccctgcctcagccacccaagtagctaggattacagacatgtgccaacacacccatctgatttttgtatttttagtaaagatgggggtttcaccatgttagtcaggctggtctccaactcctgacctcagatgatccacccgcctcggcctcccaaagtgctggaatagatgtgagccaccgagcctggcccctgtaaaatattaaaccaacaatcgtcttcacaatggaggtggatttaccatgaagccagtgaaacccttaacctgcacagactccccttctaagactctgtccctaatttcatgttacttttcttaaaggagcccccaaagtgtatacagtataagcttcagacttgacaacatgtagcccatctctactcacaagtttataagcaaattaaaaatcaccaggcatttactagcctttattgtatactttcagacaaccacagagccacagaaatccttgaaacatggtttcaagggaaataatgtctggcatctcaatgcatttctaaaagccaacatctttctcttaagactagctattcctttttcacttctctattggtttaaacagtgttaccatttccctccatcacctggtaataatcatatggtctcaaatttaagcacaataattttcaagctatcagctatctcaattaactattactgatcactggtgccatggatagagcatgctggatttaactataagatagacctgagttcaaattccagcatagatatttactagttatgtgacctttggcagttaacatcttgaaacccagttttctcaactgtaaaaacaaggatgagtctacctgcctcactgaattgtaatgaatgtaaagtacttagcacagtactaaatgcatttgaaacatcacaaatacaacccaaatttcattttaaacaattactttcatatatcttccccatcagcttttaactacatcttctaaacagaaggaaggataacttatttaagataaagatgctttatctcatcttattcctcttggctatatatctgtaggagacaaaaatagatattgtcaaaatttagtaacaattattacatgcatatggattactctaatctacatagctcccacgctgatctctcccacaaatttcagcgccacatgttaaaatttacttctggggattcacctagatattttcctggcatctcaatccatttctaaaagccagcatctttctcttaagattagctagtcttttttcatttctctattggtttaaacagtgttaccatttccctccatcacctggtaatgataatatggtctcaaatttaaccgcaataattgtcaaggaaactttatatattgagtgtttcgtgtgcttctttgaaaggagtcagttgtttttggcccagtgtttttttccattgttgcggtagtttcttttcccaccttgagtcctcatcatccaagctcagtctttgcatctatctacattaactcttgaggagctcccttctagtgccatgaacataaatattatccacatattgattaccccaattttaggtttggctgttcaacttctccacttgaatatctaaataggtaatacaacttaacatgtcccaaaccgaacccttgattccttactcctaacttctcccgatccgcaaatggcaactgcactcatccaggtgcttcaaggccaaaaccctctgcataatccttagtttctgtttctcacacccaccaggcgcacaccaggaagtcattttgcctctatcatttaaatgtatccaaactttgtatctcagcctccaccactataccctagtccaagccaccattattctcatctgatgtattgcaaaagtctcctaactagtcagtgtgtttctgcccatgcccttccagtagtctgtactaaacatgggagccaaagcaatcctttggaagttagaaagaatcccatggcttcccttcacacctggaataaaatccgaagtctttgtcatgacctatgaactctccaggctctgatctcgggttctacccactttttcctaggcccatcatcctcatccagacatactggcctccttgcttttccttacacaaccttctgtttgctctttctgaagtactcctttctgagacccacatcacttgttctctgactttagtgctctctgaaatatcaccttatcagagaggccttcttgacaaccttctattaaaaaatcctccctgtcccttccccaacattcatgctttgtctcctttccctgctctacttttcttctcagcacttattactagaatgctagaccttagaaagcgagactcagttgatttcattcattaccatatcctcaatacctagcacatcagtgaatgtttgttgcatgaatgagtgctcaaagtcacatgatcacacccagcttcattagaaccttgtctgagcagccgtatggagctttgtaatggggttaaaatcaagggctgtgaaaggaggcatatccgaattggactcctgactctatcacatattggctcactctgttttttacactgctaagtttcagtttcctcactataaaatgggggcaatcatacttacatattctagttgttctaagggttacatggacatgagaagtgtctaacacaaagtgtgttcttaagaaagtcaatgttatgatttccattgcattaggacttaggggaattaaataacttgcctcaagttataaacaataactgacaaagccaggaagcaaactccgttcttttgaatgtccagttgaaattttagggtacaatattcttttcaaccctagaactcatagggcacttggtggactgttattccataatgagtccataataaatgtaactaacagactagacaaatgaagagttacttcaataaaaggaagaattgtggaattgtgttttctacattttcatataataatagtatatttgaaatagtagcaaaacacagcaatacagtactattaactataataccttattgattataaaagttgtacattaaataagtgaaatttgacatacacaagaaatcatagtgcttatttctaagtacaaccattataaacattttagggtgtatctttccaacttttttctagaaacacacattttttaatcaagatacaatcatagtgtttgtaaggtttttaactgatttgttttcatttaagatatctcatggtcattgttctatgtgaaaaaatatagttctaccacaagtgattatgatatattgatatgtatttaatcatatagctagagcattatgtgtgtatttatttatttaattatctatcaaatgatgtttaggtggcttttagttttgggaaatcaaatattattacttatctttgtgaataattatctgcttagggtaaattcctaaaattttgacacataccatcaaattacctccagcaagactgatcctatttacattctcattaacagcactgggaaaatgtaaagctaaatctagtgaaagtttgctaagacttgtcttttttttttttattttaaatcatagcatgggggcattttttttattatatattttttcttctcctttttttcagagacagaatcttgctctgtcatccagactggagggcagtgatgttctgaacatcgctcactgcagccttcaaatcaggctcaagcaatcctcctgcctcagccttctgagtcactggaataacaggtatgtgccactgggcctggctctatattttcagtatatttaaggcatgtcgaaaaaaaattgtatagaaaattagatttttgacataaaacgatagcttattttcaacttcctttagagtctctatctgcattgaagatatgtgagactcatccaggtgaattagtttacttaattttttttttttaatttttgccattgacacagttctattatgttgctaatgcctgcggtttagtgcatagttaggtaacttacccttcatttaagaaatgacaggattgtctttatttctttaataattgcattccttctggactttaaggaccatgaaatgatgagactacttattgctgctccccgcctctagcacagtgtctagcacgcagtcaacactggataggcatttgttgaattgttgaattgtcttctttgtagtcaaccacttttttccttgctggtatatttctcaattttgttgttaattatgttgttgaaaagtaacaaaaaggaaatgtgtattggggtggggagtagggatccagttgctttctcaaactttgaaagaaattatagtgttttagcctatttgaaaatatgctttgtatgtttgaaaaacataatcatttataataacattcttcaagctccagctattacatagtaaatataactcttacaatcttggggggcaagagtcattttctctctgaatctgcattttcgacccttaaatttatcatctatcatactggtgttctactaaaacttatgcaaatgtatggatattcctttttaaaaataattcctcctctttggtactgtgctcattctcctttctatctttcatagttttctatcattataattaatgacttcgtgtcagaacacttttaggaagttgctctactcattttcttgcctaaatcatcctcctacttgatgtctaatttacatgatttaaaatttccatattgcctgtaaacagtcttttcctgcttaatagcatctttccttgtttccataccaacttagaaacacctgctgaaacagaaaggtaaacaaaccagagtctaagagtttgcagtcatgtttaatatacagtcacaaaaatgagtcagccgatgcagtttccatacacgaaaaggcaagaatacagagcagtcctttgccatgccatacatgtgcatttcaatccgcattctggaaagcacccgcagtttaaagttagtatttgcaaaaacaggccaatgtggtttatttcaggacactgacagatttgaaatggctgctatactaaccttgactggtcagaataccccagctagcttttcgtttagaagaacattcctctatactcactagccttcttttcgtgaggacctgcttaatgcagttcatttcaacagcaatatctgcggacatagtttggttgacgttttttgtctgtgacaaccaggtgtcataagtgcaaatgctctagcaagaagaaatatcagcgtctggatttctaactattttttccttcccttcagactttcacaaaggttcctgtgtgctaacttgagatgtcttcaacattgaactctattcagaaacacttggatcagggctggtaggtgcaatgtggaggatgggccagaaatgctggagcattttctatttttaaagcagagacatgctgcagccggaagtctttaactatttgtgtgatatagaaagtaaaaagtgggtataattgcttttcctagtcgaaacagaatagaaatgagctctatcgttaaaagataaaagcctatttaaagaacctacaaatcaatcaaatgtaaaattgcctgttgataatgactgcagacagaatattgcagccagaaagctcagtagtgatcagtgactaggttagcctttctccttcatcctcaggagtaagtatgagatgtgccttagggctgggcgtggtggctcacgcctgtaatcccagcaccttgggaggccgaggcaggcagatcacctgaggtcaggggttagagaccagcctggccaacgtggtgaaaccccgtctttactaaaaatacaaaaattagctggacatagggacggggcgcctgtagtcccagctactcagaaggctgaggcgggagaatcacttgaacccgggaggcagagattgtaccactgcactccagcctgggcgacagaaggagactccgtctcaaaaaaaaaaaaaaaaaaaaagtgcattacggtcagctggtagccagctcatgttttcattttgcaaggatctaagtttagaattggcttcaatacaaaatcacagtcctcttatttatataggcacagctcactattgtgatttttctagaggtcatctctaaatcaaaagacgtcagcagtcaatttaagtacagctgagatttttcaccctaaaaggcagaggaaagggtagttggcaggatgagaggaaaaaccaaacatgtgcctggtattttttactggcctataaagttgaaaaaggcacagagtctatgatggaatcaagagcagcgaccgaactatgataggactccaaggattaactgagctggtgatcacgttacagagtattaacatactgaaatctgtcttgctgaaatatggtgacagattctgttatctatctttttttcatcagtatttttaaggctctaccttctgctagtatataaaaggaaaaaagtattactggggttattgtcttcatgtaacaagccaagtaagagaaaaaaaaattatgactataattctgtcctatgcactaccctatggacatttgctgccatattacactgccagtgtttacctcaagttatcgctaatgaataccacacatatcttttccttatcttcaattaagttctaatcctaccagctgtttgtgtgacctggagcgagtagcttaatgacaccatagtttccttctctataaaatgaggagcttggataagaccagattctatgactaacacacaaaaggtaagagagtgcgtgagctgtagacatattatattaccacagaagaggctagatattcccaatgaaactgaaactcagagccagcttggcccaggctatttgtatgggtggcacattcctaggtgaagttagaaaagactgaaggggcctattcagtccagcatatttacatgaagcaattgtcattcaccactggctctttgtcgcctggtttgtacttataaggggagtacggtaatctacacaaaccatacagtaaaagtaaattttaatttttgtttaaaattaaattaattaaaagaaatttcaatttgaagcttatacttattattctgtaacaacaaaagctttatgcttttgaataatgcatattcctacagaatgcataataatgcataataatattcctacagaataaatgtaggaagttttatcataagtattgtgacaatttttgttttatcataagtactgtgacaatttttgttctgaaaacaattttagacaccgtatattataatgatctatttctctgtgtctcccccacttagttgtgcactctgatcacagagactgagtctatacagctgttattgcacaggtctaagtactggacctcttaagccgtgggcactaaaagagttgttaaagagtaatttgaatatggaattttctagaatgctttaagaaggctttctgtagtcctcgatggtagtaaacaaatttccagggcagtggggaaaaaagaagccattggatttgagtataactcacacttactgaactgggagatgtgctgcactgaaggtggactaaggagaacctatcaatacttaattcttttaaaaattaaaaatggatcaaaagcaaaagtaatttttaaaaatgactccatggaattggaggaaaatgatatggttaattcactagaaaataacaaagaacagaagagtgaatagattgagtgtgctcagtgtacgttctgtgtgctcagctgtatggattcataaaaagaaatgcacagtgagtgaacgcgttagggacagaattgtttaaatgctagatatctgtgattgtacctgtaagagagcactgtgaaatctcgagatatctagaagaacattaagccatatgagtggacagaagttttaaagagagccagtatcagataaaacactaggaaactaataaaaattgtaatctatagaagataatggactctgaattattatggctcagaaaaagcatctaagatataccatagatgaatgatggtctaacgttactaccgacagggactaaaataaaatgttaaaccttataggatatgaaacaaaggcaattctatctccaggaactattgtatttccattttaaccagtgctaatgtccctgaaaacatggggacctgtgtctggtttggtcactaatcctcagtgggaaagtgatgttaaagctggaaagtttcaaagaagggcactggaaaccatcaaagacatgaagacacttctgcagcagggaaatcttaatacttatagatgtttcaaactggaaggttgaaatcgaagaggcattatgacagaaagctacataattatgaaaggcatagttaagagtgagtaaacgttttcaagaaattctgaaaaacaagaaagcaagatcaccttctgacaatttttaaagctaaaaacttggggacacaaatttagcttttttggcttacacaaccaattacaaacttaaagagctcactgcttccaagaagtggtatttagataaattaacaaatgagtgatccacagatatggatttttgagggtatattcctgagtttggggacttaaaagtaattgttcctccattgtcagaaaaagaacatcaggataaatatattcctacttggatctgggttggcagttttccccattttttactacaaaaatttcaaacatatatgcgcgtccatgcacagtgtcaacaattatcaacttacggttagtcttgtttcaactataactcacccactttcccacaaaaactcctaggattattttgaagccaatctcagtatataatttcatccataaatattttagtattatctccaaacgatgagtattctttataattataaccgcaatatcataatcgcaaaaacagcaatactataatattaacaaacacaggttgataatttttattttctgaaaagcaactcagttcacaaactgccttcaataatgatacttaagttgatataacttttaagtcctttatctcaggacaaaagtctgtgataatctttttatttctgaacgtcattttaaaagtgtaagtttcccatccttagaaaaaaaatgaatgtttactccaaaattactattaagggctcactaagtaaaaaaataaaacctccttaaatcatcacagagaaatcctaaggttttcttttacctgttactgccaaatttccaccattgcaaagaggcatctggaaggggccattattcagttctcagaggctgtgctgctttgggtttctttacaaggccgtgccctcatacaacctttaggagtcatatctgagcccagttcttgctccattttattttttattctactttacttaaacatgagtacctaaatctgttggcctagtgatagtgagtgagggcagatgaggtctgagagtaagcctgacataagcatcttggaaaaaaaattgagcagttgttatccaacagttaacctttgttccaaaggtcattcatttattgtataaaggttgctgggaaactacagatgtcaatcttgtggtgagtgatatctcctctcctataggagagaatggagtggtgatctggaagctatggggaaaaaaatcatgaacgtgtctgtctatcaccatctttgtcctcaatgacgtagatgacctaaggagaaaagggtggccttcaccacaaaactgcacatacacctgggacgcggaagggtcaaaggggaagatccggtgacaggaggacaagctttacctccgcatgttgctaaatgaccagtgacgtgtgcaaacacccacggcacctggtaccctacagcaaaattcagaatcccagctgcagcttcctcacactgccatccaactcttacattatcttttcttccaatctcacttggaacaacacaaaaaagggaaacagatccaacataaccaagctgacacaacacggagccaccacagatgacaaggttacttatgcttgacttcatgacaggagtttgggactagtctcttgttttctctattattgtggttcacatactagaaatatttccacctgtaatgcttggtagaagtcactagtaaaattatctgctcttggagttcttctgaggaattttaaaaactacttatacatatacatatttgaatttacaactatttaagttctctcttctaaactcagcttagatcagttgtgttatttagaaaattgtccattttgtcttaatattcaaaattattggcattatgttgttatataataaccacttatggtaaaaatgtcagcggtatctgctattatagtctcttcctcaatccagctgttgtttatttgcacctctgtaacaacgacaagtttggacagaggttgtctgtccaaagaaccagcttttggctttgttgattcttcctgtcttcatttttcactttattaatttctgcttgcagctttcttattttcttcatcaatttgtggaaagtgagtgttttattctttacataattttgatttcttgacctatgagttactttaaaatattttttcttaacttccaaataattttttttctaattacattttgttaatgatttctacattaaaattactgaggccagttatatgttccctatcagaggtcagccaactatggctcataggccaaatttagcctatcatctgtttttgtaaataaagttttattgtaacagaactaaactcaattgtttatatattatctatattttcttttacataacatcaaagttgaaactgtacgcaactagtcccacaaagttgacccaggagactaaaatatttactctttaatcttttacaggaaaagtgtgccaacctctggactttataatattagtcatttaaaatttactgagacatactttacagtcctgtgtatacttaactcttataaatgttcaaagtgtccatgaaaagaatgtggatgtgaagttccatatatcaattaggtctatctttttaaattcttctacatgtttatataatgaagatgtctgtctgcataaccaatcaattactaagataatttgattaaaatttttctccttaaaaattaggtaaatttttgaattttatactgtaaagcaattttattatgtgaataagaattattacagctttttagtaaattcaacctcttattatatagtggcatctagtaggttttttcctttatttttattttttatttttttggagacaggtcttactctgttgcccaggctggagtgcgatggcacaatctcggctcaccgcaacctccgtctcccaggttcaaatgatcctcccacctcagcctcctgagtagctggtattacaggcatgcgccactatgcctggctaattttttgtatttttggtagaaacggggtttcaccatgttgcccaggctggtctcgaaccgctgagctcaagcaatctgcctgccttggcctcccaaaatgctggtattacaggcatgagccactacgcaggcaattttttcccttaaagtcttatttttctcatattaatatagcaacagcgctttaagttagtatttcccttgggcacatctttcttgatccttttattttcaacctttctgaatccttatgttttagacaggacatttctaaaaatatattgctggatattacaaaaattcaatctgaacattgtaatcttttaactggaaaaaccattcaatttatagctatttaatcaccgatgtatttggatttatttttcccacattagtttggtgctttgtatttgactcaccatttctatgtttctttgctcactttcttttgttcttttaaatttttttataatcccatatttctcgcttctactctgaatggtatatattatatttatgatttttaaaacactgtgcctaaaattttattcagactcaagcattaaggagagctagaataaaattatagccataatcttgtctacagaagtgacatctttcaagtataagtttggggtgatacatgcttcatacaccaaagcacaaattcattgatgtacagggcataccacataaaccacatttacatccacagctacatacacctatagcacttaataaaaatactgctgtttttaataggccaattactacttcaattgctatgtatgatttaaatctggaacagctgtttaaaaacacgatctcacatctagtacagggaggcactgactcttcctctaacagtggctatctctttgataaatctcaattttatcctacgaccaagtgaaaatagccaaactgtaaacagtcacttgagttaagatgacccaggggttgggcctggtggttcacacctataatcctaacacttttgaagaccgaggaggtgggagaattgcttggggccagtagtttgagatcagcctgggcaacatagcaagacccccatctctacaaaaaaataatttaaaaattagctgggcatggtgacatgtgcctataacaccagatactcaggatgtcggggcttatcctgagtagctgggactacaggcacactacaggttcaagtggggaggatcacttgagcccaggagttcaaggctgcagtgagctatgattgcaccactgtgctctcacctgggcaacagagatcctatctcaacaacaacagcaacaataacaaaaaagatgacccaggcctcacctcagtcaccaccctctttataagctgtcccctaaagccagctcttcaggagttcccagataaacttaattattcattaccaggaagtgatgagatacgttatgaagctatgcaaacataatgaaacacaaagaaatcccccatattgacaaagggctaatatccagaatctacaaagaacttaaataaatttatgagaaaaaatcaaacaaccccatcaaaaagtggggagaggatatgaacagacacttttcaaaagaagacatttatgcagccaacagacacatgaaaaaatgctcatcatcactggtcatcagagaaatgcaagtcaaaaccacaatgaggtatcatctcacaccagttagaatggcgatcattaaaaagtcaggaaacaacaggtgctggagaggatgtggagaaataggaatgcttttacactgttggtgggagtataaactagttcaaccattgtggaagacagtgtggcgattcctcaaggatctagaactagatataccatttgacgcagccatctcattactgggtatatacccaaaggattacaaatcatgctactataaagacacatgcacacgtatgtttattgtggcactattcacaatagcaaagacttggaaccaacccaaatgtccatcaatgacagactggattaagaaaatgtggcacatatacaccatggaatactatgcggccataaaaaaggatgagttcatgtcctttgcagcgacatggatgaagctggaaaccatcattctgagcaaactatcgcaaggacagaaaaaccaaacaccgcatattcttattcttcggtgggaattgaacaatgagaacacttgaatacagggtgaggaacatcacacactggggcctgtcgtggggtggggactgggggagggataacattaggagaaatacctaatgtaaatgatgagttaacgggtgcagcaaaccaacatggcacttgtatacatatgtaacaaacctgcacgttgtgcacatgtaccctagaacttaaagtatataaaaaaaaattacacagataaaaaaaaagaaatcccccatattgatcttggtgtaaaattagtaatggttatttaacttaggctaattagaacttgctgtgttgctgttaaaatatcagaattggaagaagtgggggaaaatgttttactgtatttaattttaaccataaggggaaaggcttttacagctactataagactatttatgggtcaagagataatagggaaaaaggaagaatgatgctattcgatgagatttttctgaggcaatcttctataaagtctttttaaaatcttatcttaagaaaaagaagaacctttcagaccacctatcagatacatgcagtacatgtattcaggatgtaaggaatggactctgaaagataatttcacttaaaccagtatcacagcactagccatgaccacagagtatgagtgtagacagtccacaccacagtgcagttgcttatttagtgagttcaggtgctgtgaactgtttctccagatattaaagctgaaacatgaactacaccaataatgatacggggaatgcttttttaaaaatgcatttgcagaagcaaactctcctcagtatactgaatgtctagatgtgtacacagctcaaagtgagatacttccttaagaatggtaaggggtagctacaaaaacaaaacagaaaaccttcagaagacgtgatggttaatgacagaatgtcgaaggctttccctctcaattgaaaaacaaaaatgaacactccctaccaccaatctattcaacatcatacaagaggtttaatccatagaataaagaaagaagaagaaataaaaatggtacaacatttagaaaggaaacaaaactctcattattcacaaataatataacttttcacataaaaaatccctatagaacccatagattcctattagaattaataagagagcttagaaaagttctttggtatgaaattaatatacaaaaattaatgtatttctctctgcccttgacaaacaggttgaaaatgtaaaaatttattaagatattatttatggtagcataaaacaatttgttacctatgaataaattcaacaaatatatgtaagatctccccaggagacgataataaaacattattgggagatattcaataaaacctatataaatgagaaactatattacatttatgattgaaaagccaagtattacaaagttgtagattctccttcaaataaatgatttataggttcaatgaattccaacaaaaatgcaacaagtattgtgcgaaccacagaaattacttctaaaattgatacatagaatttcaaattaccaagaatagccaaaactatgaaaaaatagaagaatgtgggagatcttgttctgtctatgaagacctattctaaagctacagaaatcagtttagtgtagtataggtccagagcaatgtaattgataagagcccataagcagactcatgcatgaataaacactagacttacacaaactgggcactgtagtgactatagattatgaaatatagaacccactttccaatacatggtgtgaatataattgaccatgcatttggtgaaaaatggacttacaccatacaaaaaattaaattcaagtggatgaatttcaaaggaatgctttaagtatatggaagaaatacttccattaccttgaagtgccaaaagatttttaagatgaattccacaaaaagtcttaatcaaagtggaaaggatttgtaaatttgactatttttaaattaagagtttctgttcaccagtagaaacaccaataaaaagtgaaaagtcaagccacagaagatatttgtaaatagttcttctaaatgttttcattttcttaacaattttaggatacaaaataacttctaaaactcaattttaaaaagggggaagacagatggcctgatagaatagaaggcaaaatatttggcgagcacattgcaaaggaagaagtacaaatggtcaacaaaaatcaaaatggcattattagtcagggaaatgaaaattaaaccataatatactcccacatgcccaccatattggcaattttttattttttatcttttcatttttttgagattgagtcactctgtcatgcaggctggagtgcagcggcacgatcatggctcactgcagcctcaccctccccaggctctggtgggtctccctcctcagcctcttaagtaactgggtctacaggtgcacactaccatgcctggctaacttttgtattttttgtacagatggggttttgccacgttgcccaagctggtctcctgagctcaagtgatccacccacctcgacctaccaaagagctaggattacaggtgtgagccactgtacccagcccacattggcaaatattaagagtactgacaatatgtgaattctcataacctgctggggtttcaccacagatacagccacattggaaaacagggcaatactgtcttagaaactggagatacacaggccctatgacctggaaatttcacttctagagctataaaaacttatttatactagatgtttatagaaatattgttcataattgccccaaattggtaatggaatttacattattgagaatgaatgaacctagatatatgtaggcaattatatcatactgttcattgtaaaagtaaataacaaaagaatatttagagaatgattcaattaatatagggttcaaaaataggttaaaccatatcaatatgagatgtatgcataggagctgaaactaaagaaaggcaagaaaatgattactataaaaactagtcactcggtcttgatgggagaaggagaaggtattgtgattgaaaagagatacatgaaggcttctggggttctatttcgtgacttgaatggttgttatacaggtttacattttgtttgttttgttttgcttttttgagacagagtcttgttctgtcgcccaggctagagtacagtggtgtgatcttggctccctgaaacctctgcttcccgggtcccaacgattctcctgcctcagcctaccgagtagctgggatgacaggcgtgggccaccacacccgactaatttttgtatttttagtagagacagggtttcgccatcttggccaggctggtcttgaacttctgacttcaagtaatctgcccgccgcagcctcccaaagtgttgggattacaggcgtgagccaccgcatctgccctatacagttttgtgtttcaaaatcttgtattaaactctgtaaacaaagttctgaccatttttcccagttgcggcgtattttatgatcaagaaaatactaattaacaaaaagatcccaggtaaaaagattttaaaatagaggcagaggttaacagaaaatgcgacactcccaatatgagaagagaagagtaaacacttggctcttcttaccctgctgttctttattccaacctgcagtcttagtgggactctctgctctccctgattgggagagcagatctgctgaatgtctgctctaccactgagggtaataagagacttcagttcttctcccattggtgctgagaagtaacagggcatccgagaagacctaggaaatttctcctcatatgaaactgtgcttggtggagaggatgagaaaacatggagttagacgagtgctccagagggctggggaagcaaaatttccaacagcattctttaagtgaccttaggcgatccttaaaagaaagtgagttggccgggcgcggtggctcacgcctgtaatccccgcactttgggaggccgaggcgggtggatcacgaggtcaggagatggagaccatcctggctaacacagtgaaaccccgtctctactaaaaacacaaaaaattagccgggcgtggtgacgggcgcctgtagtcccagctactcgggaggctgaggcaggagaatgacattaacccgggaggcggagcttgcagtgagccgagatcacaccactgcactccagcctgggtgacagagtgagactccatctcaaaaaaaaaaaaaaaaagaaaaagaaaaagaaagtgagttaagtgaaatatcacctgcaaggccacagggagtgtcctaaaataatgatgattacacattatttggtgactcagtgcagctgttctgagttcggtcaagtacatttacgttctggaatagggtggctgaggtcacgggcgtgataaattcacaaaaggtagcttgggttctttgtgctaaaagtttctctggccaggaaactgattcaccaaaagtcaaaataaatgtgcatagcattatttagcattcagagctaaaagtggacgtagaaatcattttctttagccatttacaaatggcttcaaagagcccgaggagttcaataaagtacctcagagtgtgctggcaaagtgtgggctgtctcccatcagggtagcttccactctcagctttacaaaatgaccttccagatcacaaaagaaagccccaatggctttagaaaagattcaaaaaccagtgatcccgtctaactccttcattttgcagataaagaaacaggtcgagagaggggaggtggcattctcaaagcggctcatagggctatcagcaaaacaagacaggaacagagattgtctgcttctgacttggactctttccaatgtactagattgctagttaacgccacgtgcgaacaaatctaaactagtgaatataaaacaaggaagacagaaacagatctctcatcaccagcacctacatcataaggttttcataaagattaaacgtgtttataatggtacttgtttagagcagttcctggcatgtacataagaactgggcatttaccattcttataaaatgacacttttctggtcctttcattctttttacccactttgtccacacaccgttttatctaccaactgccagcttgaaattttcaaagggtcgcaaatccatacaaggaataaaatcaacaatctgtgttctctagtctgaggacaacagctgccgaggagaaaatctgatctgcaccatggacaaggacttcatgtaagaaccatcttacacataaaccttctcctccccatggctctagccacagatagttttatcaccgcttaaccatgtgctcatgggaggtttagcttctgacagcagttgggacgttttatgttgatacttttaatgaaaatcaaacgtatttgcagaagtgtatcttaagagcagaaagcaggccgggcgcggtggctcacgcctgtaatcccagcactttgggaggccgaggcgggcggatcacgaggtcaggagatcgagaccatcccggctaaaatggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacacagtgagactctgtctcattaaaaaaaaaaaaaaaaaaaaaaaaaaaattgtttgaagattggctcagaaagcttaaaagattaagaataaaaatgtattcaattaaaaatggagaatcaaaaggtgaacaagcagtgttctttacttaaaggaaaacgatcttcgagttaataagacatgaaaaaatacttgaatacattagcagccattaactgattctagttaaagagaaacacataggaccagcatgattgctcacgcctataatcccagcattaggcggaggcgggaggatcacttaagcccaggagttcgagaccaccctgggcaagcaacatggctagatcccatctccacaaaaaatacaaaaattagccaggcatggtggtacacacctgtagacccagctactcaggaggttgaggcaggaggatggattgagtccaggaccttgaggctgcagtgagctatgatcacagcactgcactccagtctgggtgacagagcaagaccttgtctcaaaaaaaaaaaaaaaaaagaaaaaaaaaaaaagaaaaagacacgcatataaaatatttttatttggcggagtgtgcaggggtgctgttctaatgccactttttgaggttaaaagaaatcgggaaaagggacaatatgtctgattaagaagaaggaatggaaggcattacttatagattcaacttcggacagtattgattttctgtcttcacttgttgtttgaaaattaacttccagaatcaatatccattaacacttattcagtgcacatgcacccgcaacattcagctagggacagttagaacaggtaccatcctgcattgaaaagggtaacaaattccattcacttaagtttgagtcccctcactttctcccttcctctttccctttcttccttccatgaatattcattaagaacctgccatgtgctggcatttgtctaaattccgaagatgaagtgaatctgtcttcatatggcatacaagctggtaatgatattgacttgatgagatggtcagtattgagtttgtttaggctgtcatgaagatggggaaaaagccacacggaaaatattaagataatccatgtcttgctggggttggtacaaagactctgaaagacagattgcaatccaatacagatattagctctagacaaaggacactgcctgttttgtaatataaagaaacaaaatctcacaaatggtaagaatgcatgatgtcagaagcaatgtcagaagaccagggctcacatttttactttcctctaagatcaataaccttgagcaaatgcctctgcagtttaaagccttttttcttctctacaaaggaagcataacataataccattaccttatgtagggcacagttatgaggattatggcatgtgtgaaagtttgtgaattataacaaaaatataatgtattagcattacattaaagtgtgaggtagggcatgttcaggtcaaagcctaggaaaagaaaacatcaaaagagactgactatacacatgtactaagtccaattacaaaactttgagaaacatgagacttactttatgttgaagaggatgtttacttttttccatttctcattgtctcctgtcttcaaatattaatcacataatatatactggaaaaacaactcacagatatacctcaatttttaaaaatgtagtctaaaaaatgtacatttataaaacagattttttatttccaaaggacaaaattcagtgatttactaaaagttcttttatacacaatttataaagcacaacagtgcacacattctggtaaactttttgactggtattttaccaagtttcaaacatagcttttaaagaacctaggatttagctattttgaaaaatagttcatactaaacaggcaaaaactggaagcattcctgctgagaactggaacaagacaatgatgcccactctcattactcctgttcctataatattgaaagtccttgccagagcaatcaggcaagagaaagaaataaaaggcatccaaatagaaatcattgaactatctctttttgctgatgatgtgattctttacttagaaaactctaagaactctagcaaaggtctcctggaactgataaacaccttcagtaaagtttcaggatacaaaattaatgtacaaaaatcagcagcatttctatacaccaataacactgaagctgagagcccaatcaagaacacaatcttgatttacaatagcttgcattttacatttacaatagctgcaacaacaacaacaaaatacctatgaatgtatctaacccagagggtgaaagatctctatgaggagaaccacaaaacagtgtaaaagtcatcatagatgatccaaacaaaaaaattccatgctcgtggatttgaaaaatcagtatcgttaaaatggccatactgcccatagaagtttacagattcagtgttacttctgccaaaccaggaacatcatttttcacagaactagaaaaacctattataaaagtaagatggaactatggaaccaaaaaagagcctgaagagccacaacaatcctaagcaaacagaacaaagccagaggcatcacattaccagaatccaaactatactctaaggctacagtaactgaaacagcgtggtagtggtgcaaaaacaaatacatagaccaatggaacagaatagagagtgcagaaatgctgcagacctacggccctctgatcttcaacaaagttgacaaaaataacagtggggaaaggactccccattcaataaatgattctggaatagctggctagctatatgcagaaaatgaaactggaccccttccttacaccacatacaaaaattaattcaaaattgattaaatatttaaatgtagatcctcaaactataagaatcctagaataaaacctaggaaacaccattctggacatcagccttatgaaagactttatgactaagccctcaaaagcaattgcaaaaaaaaaaaaatgacaaatggaacctaattaaagttttgcacagcagaagaaactattaacggagtaaacaagtgacctacagaatggaagaagatattcacaaactttgcatctaacaaaaaggtctaatgtccagaatctataaggaacttaattcaacaagcaaaaaacaaataacctcattagaaaatgggcaaaagacatgaaaagacacttctcaaaagaagacatacaagtgaccaacaaatatatgaaaaaatgctctacatcactaatcactggagaaatgcaaatcaaaaccacaatgagggccaggtgcggtggctcatgcctgtaatcccagcactttgggaggccgaggcgagtggatcacgaggtcaggcgtttgagaccagcctgaccaacatggtgaaaccccatctctaccaaaaatacaaaaattagccaggcatggtggcgcgtgcctgtaatcccagctactcaggaggctgaggcaggagaatcacttgaacccggaaggtggaggttgcagtgagccaagatcatgccactgcactccagcctgggtggcagagcaagactccatcttcaaagaaacaaacaaacaaacaaaaaaccacaatgagataccatctcactttggtcagaacagttgttattaaaaagaaaaaacaacagatgctggggaagctgcggagaaatgggaatggtcatacaacattggtgggaatgtaaattaattcagctgctgtggaaagcagtttggagatttctcaaggaactaagagttgaactaccattcaacctagcaatcccattactgggtatatacctaaaagaaactgttctaacaaaaaggcacatgcacttgtatattcatcacagcactattcacaagagtaaatatgtggattcaacctagatgctcatcaacagtggattggataaagagtatatggtatatacacaccatggaatactacacagccataaaagaacaaaatcatgtcctttgcagcaacgtggatgcagctggaagccattatcctaagcaacttaatgtaggaacagaaaactaaatgctgcgtgttgtcacttataagtgggagctaaacaatgtgtactcatggacataaagatggcagcagtagacacaggggactactagagagggaggcagagatgtgggtacgggttgaaaaactaactactgggtattatgctcagtacctgggtgatgagatcaattgtaacccaaacctcagcatcatacaacatacccaggtaacaaacctgtatcccctgaatctaaaataaaggttgaaattatttttaaaaagaaagaaaaatagcaattatgctacaatactcctattctggtattatcacacagaactggatttctataatctcagagaacaaaaggtcattattgtattattagcattattctttaaaagtctattagagactagcaagactgagctatgtcctgaaacttttaggggctgtcatatatggctgtgttattcaaaaacgttactctcaagtttgcagttcaccataagatattccattttgagagagttctttgtccttcatcatattcctgccaagctttgagtagtaaaaactcatttctgacttgaggctgagattcacacctgcctacatcacataggagaaagctagcatctcagatcttgcaactaagagcattaattttcccactgtttttattataattttgttccctattgttaacatttatggtataatggtctcatagcaaagaaagaatacaaaaatcattctttgtgttttattattttctcattggaggcttagccaccttcagacaggctttgcagtggcctggtaaaggggcaagggttcctggaaagctcagttttaggatcgatactttctaaacctgtgcataaggctccagataattcaaaatatgaattcaagtttgaggtctttcaatgattctatgagataattccatatcttcatttccaaatatactctgcttatttttaaatggtttgtttttcttttttctcataaggaaaaaaactttctgtaagatatgacaaggaaaactatgttttgccaggcgtggtggctcatgcctgtaatcctagctcttagggaggccgaagcaggtggaaggcttgacctcgggagtctgagaccagcctgggcaacatggtgaaaccctgtctctacaaaaattacaaaaattagctgggcatggttgcttgcacctgtagtcccagctacatggggggctgaggcgggaggattgcttgagcctgaggcagaggttgcagtgagccaatatcgcaccactgcactccaagaaaaaaagaaaagaaaaactatgttttggtcacttcctgaagagaccagctggcagaaaggagcagagaaaataaaggaaaaaagacaaatccctgagctagctgactcagttctttgttgtgaatgttgacattagattttgtctttcactatcagctgccagagattatgagaaaataaaataaaaggacaagaggcttttaagaaggatggtttggcaaaggacgttactatctggtgctttgttgtgtgctggaggttaagcagctttgactctttctgtggcactgactataatggagagccaagaatttgccaagacttgccattgttacatgctgttatgtaactcatcaaagagttctttcagagcaacccaggctttcccacaggacaaccatgaccaggtatttgaccaaatgcgcccaggaaaacatttctgtttgaagaatttctgtcaagaaaagtttcttggacagaataagattgtagaagaaatttctgcaagtaattttaaaactcccaactctgaactagccttcccaaccttaacattctgcctaggtcctggtcacactagccaaactctgcattactttgctccaatcctatggaacagctcagaatgtcttactttcctttgtatcagagggagtacctgcaaaaacataccttgagtcttaaaggcataaaataaatggcttatttttggcaagcattgtattttctgtcttttaaaatagttatagttctccaatatctttccttttatatagaaagggccagtcgacaaggcgcatggatggcacagagacctcatgcacacgaggctttgattttgccactcaccccgtgtttattcggtgagaaagaccatggagtggaagaggaatctgggttggaattctgcttcttctagttactacccgaaaaaactgacaacttactaagctctttagagcttcagtgaattgttacattggcagataaatcaagctgacctctgaaacgatctaaccaaagagctaatatgatcctggggtagaacacctgcttagtagacaggtcctggtattatattatgtgcttgtagtaaccgtttggcaaacatagttaatttattacaatgttaatgttactatcttttcctactgatgctttcctgtgttactaaattataggcaattctatcctgtttttgaattttttaaaaaagtatgatatagaaagttaacatctatagagtgttgactttacgccagacactgtggcaagtgattaaggtaataaattatatttcatataagatttctatgaatccgctcaagtagtatcaatacctccattaaactgagatctacagacgttaagcaactttcctgagatcacacagctagaaaatgctacaaccatgacagaacaatttatgtctgggtcaaacattgtgcaatatgcaaggggtttttaacctccatattctctttttttaaggtcttttattcattctacaaccatttgctgactttcttcaatatccaaagcagtgtttttcctgcatgccattgagagttatttcaaggaccaagtgactttggtctaggaaattgaaattttcttctccataataaaagcagttttgactgatctacttttcttgtagcccgttaaaattcagtctctagtcaagtatttggcaagaatcacaggtttgtctcatgagccttaggttaattataaagtacatagttttttttcttctacttaaaaacattgtctttcaaaagtaatggaatattccttataatgctatagaaccaggtttgtagtcattttgtacatgctttctaaaatggagctttaaacctacaaaatctcgatcactgaattcaattaagtttcataaataaaaataaaaatgctttttcaaaaaaatagtatcatcagtttcagtagactccaagtactaagcttacttaaactgatttcttttcacattcttggaatgtcacaccaattagatatgcaactattgttttgggacttaatgttcagtaaaggttttttttctccagccagagccagtcttgttttgttggtttatttgagtaatggtaagtagccagaaaacttagcccctatactagattctacttgagcattttcatcataactatggtgggtgggagagagagagaaggagagagatgcttacagtttcatttcactccttttcttttagttcttggagttacaatgaagtatttattctttcctggatgcaacagatctgcgacctgtgtatttgagctctaaagaattagcactttttccttttccaaattcatgattctagatcacaggtcaagatggaagtaagacacaaaacttccaaattcaagaattcattaggtgcatcatttcattctaaaaatgaactattacttttacttgatgaatgacggaaacaccatttctctagtgaatgaagtagaatttggaaaacataagtgcacataaatctcctcagtggctaatcaaagatgtatttggttgctactgaggggttgagtcactaccaaagtcaccgctgtttccatggtcattatttaacagctcttgtagtgcattgagtctgctttagaagaagtcttgagactgctttagaagaaggattgcttcctttctcactttgacagccttacctgatttaattcacaagggactttgcggcattatgatggtgaagagcagatttccaatggatgggccttcacttaaattttatcattgtcagctttcatttaaatcacactgcacacttgacagctgaggtgagccagtgcttctatttaaaaacatgaatggcattttggtgttaaatttcagtttgtttgtactctacccatagtttaagactataagccttctggaaagagtatgtgtatttctgaaggtttctattttactcagtgggtaccggtggcatggaaattttagctgccctgatagagagaggatgccttcctgacatttcacatagttatgtacatgcctgacaggccccaaatgtttgctgctcatctaatccctaggaaagaatttcgaaaggatattcagctatgactcatattatcagatggttaggttctgtaaagatatgtgtaacaaataatattttccataaactgggacagtctagttttaaatattattttatccctttctttgaagaaaaaattattactattttaaagcccaacttatgaagatttatgaaagtagagttgttctgttcgaaagggggaaggggacccatggggaccttgccccctcacaccaccctagcttctgagcccctgacggccttctagaaaaatcttaaatctaccttaaatatgggatattaatctatcttaaatctataagacagatttttaaaatccttttccatggtaaccaatgaggaattgtagaatgaggattgagaaaaaaaatcatctaataaatgttcacctttaacctaaatttcacagagtggacttgtttaatcacagaccacctggaagattctttcagtattcatttaacaatttatgatactccttaagcctctccctccctgacatgatattctttgggcatttccagtctaaaaagccaatggtctgctttgtagcattgctgagggaaggctggaaagaataaatgacttgttccctatgcagctgataatgttttgttttgttgttgctgttgtttgtttttgtttgtttgttttgtttttttgagacggagtctagctctgttgccaggctagagttcagtggcgcaatctcggctcactgcaacttccgcctcccaggttcaaggattctccttcctcagcctcccgagtagctgggattacaggcacgtgctgcaacacccagctaattcttgtatttttagtagagatggggtttcaccttgctggccaagatggtctcaatctcctgacctcgtgatccacctacctcagcctcccatagtgctggggttacaggcgtgagccaccacgtcggcaagaaatgcgaaaagttctacatcactagtaagcaaatgctttctgtctttttaatttttaaaaattatttgagggtggctttggaggaagaggtgttccaaatacttcacctgcttttaatggcatggtttatctgtcactggggataattgttcttctctcctctgcagtttagaaaatgggcttaattgctaaaattgttgcccaagtccacagaattaccatggaaccactctgaggatgcgcagtgctgagtcagtgttggggaggtattccatcttctctgagatgtacttcatgaaacacacataatgacatattaaatcattataccaagtattttgtaaaatatttatggtggtaattatttccgtcattagctagcgaccctttttcatatgctgaatcctgtaaaggtattagaaagttcttaacagaacttctgacttttagatatatgcttcgaaatgtgtgtttatttttcccattagcatcaaccactcaacttacgtttcttcatccctgacatttatacttccacctttgctccagatgagacagccttgtttggctccacattctaaacttttcctctttttttctttatatttagcttggtttcatctccacatctacataaccaaatatgttctgcctttggatttctgccttaagctctgctttatttatgaagtgcttacagtctcagatgacctcaatctcttccctttctgacttagaggagaacatcaattgcaaaacttgactgttttccttttagcgccatatggttttctacctccttgctgtttaggttgtcttacttctgcaatgtttggctccgctcatccaagccttctgcttttactcatatatcacacatggcaaacatatacatatatataatacagaaattatatacatgatatagtatgcattttatattatatattagttatgtattacatattatagttattaaatactatatatattacagatatgttggtatatgtgcatgtagtacacaacattgtgccaggaagagagtagatatcccagtatttattcaactaagctacattcaaagctatagcagttatggcaatgaataagaaaaatagcttattttaataattcactgtcttctaaaagagatagtaaattgagaagcagaaagttaagacctagttttcattccttttctatctttactatgtaaaaaattttaaaacgttgacaatatcaacgtcccctatcaaagtacacaaaatccattttgaaattttttcatcaaaatattttccatttttcacaaagcatacttgtgtccttcctaaaaataaattcttttaacaacagaactctgagcctaagataaagctttaggtaagagatatatgagtcagaaataacaaattgagaagtgaaaaagttggtaggaagtgaaggtggggacttggcaagtttttgagcattgtgaataaggatgcatgcttagttgtgtgagagaatgtgtgtattgttagtatggcttctgtgtaactggcatatcctaggcagaaccattcttagctctacatacatttctctgtatagcaccttcccatagcaccttctttaatcttgtaaaatagcaatttccatgttttaaaattacttgcctatccatctttcttccactaaactgtgtacactgttgggaaagacagtggttagtttctatagtttatccttagggcctagcacaatgcctttgacctggtagatacataaataagtgttgggcaagtacattatgttgtaagtaataaatgagcaactaactgaatgattaaaggaaggaagagatgaacaaaagatataagaatattcctaggaaaactgatccctcctaaactatcaccacctatgtcaattttttaacttaaaatatttatgcatttctccaaatctaaagttattaagtgctatggttttgatatttgtcccctccaaacctcatgtggaaatttgatcctcaatgttggaggtgtatagtctaatggaagatgtttgggttatggggatggatctctcatggatagattaatgcttgccctccctcccttgatgctgagtgagttctcactctattagtttcggagagttctggttgttgaaaagcacacacacctgcccccactctcttgagtcttaccatgtgatctctgcacatgctggctccccttccctttagtcatgagtggaaacagcctgaggccctcagcaggcaccagaatcatgagctaaataaacctgttttctttccccagcctcagcttttcctttatagtaacacaaaatgaataagaaacagaaggagaggaaaagcattaatacattaaaatttgacagagtcttttctaaacttgtaagtttgttcccagatttcatttttgatttgcaggattataatggtttcttccacaaaagtgtttaggcatttctgaaaaagtagagcttggacaaaattaaaacctccttgaaaaaaaaatagtagcacttttgagtataatgtcatgtattttgtcatacaagagcagttctatcgattccagttattcttctgtggagttgttccacctacgtatagaaaatggtccaaaaacttccacatattgagaatatttacctttatataataaagatattattaagaagtcatcctacagatttgctacagattctttgctgagattctcagaacgtccctaagataactaatctcatgcagaggtaaccagcagcaccaaaagtcacaggaaacaagttgctcctcagaaacaggtatagagaatactactgcttctattgctagcattggctgtaaagctaaattcctaaagttgcttttaaacctaggatggagtttattaatggagaaaaaaaagatattacatcaaattcttactgcttttcctatccaggttacagtattctccaaaatgccaagttcacctgccattcagcttaaggtcacacatttatagtatgtcctatttccaagtgtctaccacagacttgacaaaaaaaaaaaaaattgcatgagtaatggcaaccctaaaacaaaacttatgaaatcacaagcataaatattctatatgatgattctacatacattgtgtattctacataaaatctcaaccgtgaaaggagcgcctgaagagcttgagtgtcaccagattgtttctcaagcagcctcacagagacacgttatcttgatgaattttccacaatccaaaatttggtccatggccttgcaggctcagaaatctgtcagcaaagctggagtaaatttacatctcagaagtggacttacaactcaatgaacacaaaatactgttgattgatatcaagatgcaaatatattaatttgcaataagacctataaatgccagatggactaaaacagtcctgagggcaagctggcacattttctttctgtggtcagatcaagatgggagccaagtcacaatcagaagccttggtgtttaaaaatataaattggaatgaaaagaatacattaaataaatcaaatgcaagactagaattcagattctaactccattacttcctgatttactttgatatttcccagtagggataggtatgtaacctaccagactcaccaagctctaagggtccactttcaaggggtggccttggctggaggctgcctgcagacttgacctgtgtggctaatcagtcttctgattgacatgttaatatctaactctgggagaaaaagctatgttaaaatgaaaaaagtaatatgtgaaaatgttactctaaggtaacattttctctttctgccaatttaaaggctatttgaatgctatttacaggcatcatcagattctttctttctttcttttctttgcctttattttttgttgtcattctatgttttctgtccgtaccactattaccaaactagtctaggtcctcatctcctcatggcaaggtcgtaactggtcaacttatttcaaatctctctcgtccaactccaaagaatattactatataaatctactttaaattatggtttaatacatacccttttttattttcccaccttctttcataccaaaaactttcaatgactcctactgccttcaaagttaagtctgaattgtttagcatggcattcaaattccttcacatctgggcccaacttattgttacttttctactgcatgaactctccactccagccaaatctactgactcccaacagtccatgtgcacccataaatccatgccttgctcattcctggagtcacctcaagctctgcctcctctttgaaggtatctctgaaagtacagattagaaaatgacccattcattctttagagtcatttggcagtgagtgttctggaaagtgactattagctgtagatagcctatctcctcaattagaatgtaaacttaaggatgagaacaatacattttgccttttatgtataccgtatcctcagtgtcttgatatcatgggtgctcaaaaaatcaatgcttagaacttgtcttgtccatttgtagcaaaaactgctaaacttcttcagagtctaagacagaacttaaaaagtattgcccttaacagaagagaagagctgcctcttgaagtatctttgggagtcaagaagtttatggcttcttctaggcctttggtatgatttcaccaaattaacacatttctccacatcctcattctctctgtatactgtgtaatatttcagtgtagccttgaaagcctggtagtctccctgttggtttcaaagtaaagagctagcttcaagaatagactaggcctctgatacataaagattgtaatcaggacacttagcaggaaggatgatacaggaggtagttatacaaaaaagcaaagcaaagaataggcccctgcagtatgatgatgagggtgataaaagtcttaagagatgaaaagatagatttgtaaagtttaatgaaatagcaaaaggatccagaaggaaatatcttaagctatttttagataccatttagcttttcagcattctcatgggtaatcataccttggtctcaagtctgataggaaagagctttaaaaaaaaccaccagatatttgtctaatacaatcagctgatttgcaataatatctaagaaaattaacagttgcttttatttcacaccaaagtactactgctcatggggagggcatccagcatgttgtcaacagggtcttcggtgattatgaaagacatgaaaataatacacgccatctcttatttcatggaatttggcaactccacatcagaaatgttggggagcagtctggctaagccttgaaagtaggaatgagaaacccaattcaaagtggaatgaaggtgataatctctcccaggaaggaggaaattgctggattaaacagagataattaagcctaattagtgacttataaagacacaaacaaaataaaaaatagtttacttatagtaaataaaagaaaaagctatgttaaaatgtagaaagtaataattttcctgggcaagaaagaatgaatgcttagaagtagaagattaagaaagagttttataaggtacctgatttgctctcttaatgttaaaataaaattagaaacaaattatgcttatattgaattaaaattataatactatattctattgtttcatatacagattaatgcatgatattagaggggaaatttttgttaaatacatctaacattaaaaataacacaaaacaaaatttgtaaaaactttgcttccattttatatttccaggaaaagtgtttcctattgatattgatttccttttttctttccttcttgagacaaaaaatcctagaattctaatttaatttaaaacagaatcctaaaagtatatgggaatgtggaaaccattgcatatattcccatgatttcccagcataagcacactaagataagtctaatgaggggatgagtgtttctttttatttgaaaatatgtacaaaaaggagcttccatggcctcctctaaaactcttttcaacccacaaaaatgtttcttctgtttaggcaatatttcatgtgttaatgtagagaaattctcataatacatagacaagatctgattatgaagtaatgtgctacaggccgcccatgagggtaaattttaccactttatgatcatgtaagctgtttactcgtgtatctgcaaatatggcttttgttttaaaatttagttttctatgtttgctgttttgtacacaaatattccatttgccaactaaattttttatgtacagattaatcacatagtgtatatgtcacattttgatatagttcaggcctggcacggaggctcacacctgtaattccagagctttcagaggctgaggcaggaggatcccttgagcccaggagtttgagaccaccttaggcggacaatgttgagactctgtctctacaaagaataaaattagccaggcatggttgtgtgtcctagctacttaggaggctaaggcaggatgatcccttgagcctaggagttcaaggatgcagtgagaattgagccactccacttcactacactccagcctgggtgataatgttagccccagtctccataaatgtataaaatatagttctctctgttctaaggcagaggtggtaggtaaagggttaaatacagcctatttacttgagattttatctttccctaaagagattcttatgaacatttaaattttcctcattttgaataagaacatcaattcctcatgttgcaaattgcagtcttcctcaggaaacatgtactcactatctacctcacacactaaaaaagattttccaccttcactcaactttccatgtactaatagagtaacctagattttaaaatgagtcgcatcccacattgaaaaatgtaggaacatggattttaagaaggcaagctttctactctaagagacttttctttcaagtttacatgtttaaattgtgtgatagtaaatttcaatgctgacaatttaagttgttttggaggtatttgggctataaatattcatgcatgcctgttgattttcaaatcagaaatgaatctgaagactatgagaatttaaaaatggcactttaaagcctgccatatgagtcatttttattttttagagtaccgacccaatagaacctaaatggttttacaaccttctgaagtctatgggtaatattgtttctcatttggtttcatactacaatttcttctaaagaacatggatgcacttggctgcacacatataaaatgtattaattatgtttctatccttttataaccaattttttacaaactgagctgagcagtaacaattccatcagaaaaacacatgtcgtcaatcttctttgtgtgtgtgctttattttagagtcaaatggttatcttattaaagttgtgagaaaccaaatcttgaaatcccctctttttaataacaattattttacacataactaaagatttaatttaaaattatacaatccaggtacacattagaggacgactgaagtgcaatcaattacttctaaaactaatctctaatactatgacttggcagatcaaatgtttaactttttaaaatgtttcttaataggaatagatatatttctattacatatatatattcctattatatatatagtatgccttccttaatctcttttgcaatgataccttgattttaacccaaacatttacattaaaaaagtaattttcctttttataaagccacgaagtgagttacaagtatttcccttaacaaaagtttataaaatatttaccttgaagcagtctaaaaagaaaacatgtaattgtggatcagatgaaagttaaactccacttgaaacaagagaggattatcataaacataccttgtccttgggttactccataaaattcagctgctatccttgccgcttccttgcggttgcctttcactatgtagaaatgactgaggatggcaaggctgattttcacaaaaagcttaaaacagaacagcgaaagtattgtaaagtagacattggataattgttgagcaaacggccgattttcttctaacaccgacattgctgcagaagaatctgcggcggtctttagttggatccaagtctcaaatgtgcctggctctcgtccgggatgctcctgaacagctggtcctgaggaaagaaaatatcagctggtagtgatgcctacagctcaaaatatttatacactccataaaagttcttcgcaaactcctattggtctgaaaatattccatggaagcaattgcatcacgtgtcacaagtctcctgactttccattctcaatataaaatgacactccacctctgtgctccaaatttcaaaatccagatattgaaatatatatgcatatcctttccattttatatatttagttatcaagaacaatttgaagacagtgtatggggttcccattgttaatgtaaatgatattcatatcgagtaaagttgtctatcatttaaggctttaaaatggcactgtactatttgtagaccatgagctaaatcagtacacagtccatggcttgtattttaatgactactcatcaaattaaccaattatgttatttttactgatttaaaaaaacatttttcttacaagtcattacactggaacatcacagattaataacttaacacggttccttcatccaatggacactttttaagaacttggtatgtgtcaaaccctttgctagattttgaagtgacaaagacaagtagaatggtccctgccacaaggaacttagagtctagtggaggaaatggaaaagaaatcaggtaaatataaagaaggtaaaaacaggtattaagggagcacaaagaggaagcatgtaaacctgggagggaggtgtcagaaaagacatatccaaaagaattatcaagtaaacatacgcatttcatcaagactgtccaaaaccaaggaaaacaatatacattttaggcctataatctttgttaacccaaatatgttttattcattaatgaaatgcatctgtatataggtatccttaggcaacttatattttaaaagagaaatagaataaattattaagaaaatgacatacagcagcaatattttggcatttaagccaaaaatgatatgccaaaatacaaaatatcatttcttacagggagcttagttacatatttctatgactgggtttggggcctgttgattgtggtacttgcttcctaattcatttgagaagttccaaaataacaaaaaacaaacataagaaaatagaagtggccattcttggaataaggagcatacccatgactggtcatactagtaagtgttgtgtgcttctctccctcggtgtatccattttatgctgagtatcttaactgactggacagatttacctgacacattccaacacaggagaaatggctgtaaaataaatatgtcaaataaagcaggctgcttctttccccaatgaatgaatggctctcagaaaataataataataataattagatctatatattagaaagaaattaccaagcttcttatgaaaatggcccctggtatcattttcagaggcagaatactggctaggcagacattaattagacccagtgtgccatttcatatgtgctttgggagtcagtgaaaattaacttcaaatagaagattaacaaaatgttcctctctttcactactggtaagactgtgtcagttgagtcaatacatgctgattcttctatggtgagtcttccctctggcatgatgatgcctgactccacactagagaggtatgcccgtggacagctgggccatcacagtgctctgagtcactgcagacttcctcttcagtgcttcgggatcagaaataaaacctgccttagtcacgtctaagtgcccatctaaggtttcagtcctttctctttaccagtaagtgctatcataaataattgtcttcgcatgagctaatcaggagcctggattctttggggttaagaaacattttcatttcactaaggctggaatcatcggtgcattaagtttaaatccttctagttttactaatacaaaaaactacagtataatatttaggattttatgtcaagatatcaggttttgtttttatgaattacttgattcccatttgtatgttctgttggtatactctccctcagcaaatttcaccctctctgagtctgctaattactaaataaaaattaagcccaaataaaatgactcatagcatacgaattcttcaagtggaaattagatgctgtatttttcatattataaacgcttccaaataacactatgaacaactctgttaatacttaaaagacacataaccacattaaaagtattgtgcatctattttcctggcattttcatttcgtcaggaaaataaaatattgattagtcattgaagtgacttactgagataaatgtttttataatataccatgttgagagactgtggtagcaaggtctagttgattagctcagtatatctcaactttcctaattttgttagcttcgatcaatcagtcaaactaaagtgttgaaactgaactcaacattgtagtactagaatgaatgatgtgagaaaagttaaaacataggaaaaatcatttattgagggtacgttggatgctacatgcatatatttatttatttatgaatttatttcatcttaggggggtgaatattattattcacattttaaaaatgagaaaagttgggctcagagagctttagagacctataaaagttaattataaagaacaacactatttgaacatagttctaactaaaatacatgctcaagttgcctctaaaattttctatttttaagcacttacaatctgattgagcaaatacgactcatacatacagagattgagacagagtcacacagattcacagacacatacacatactgcccccacccacgacacacacagaagagatcatacaagattatatgtaatcaggaacctaaattactccagtaagctgcatacatgctacaatgattaaataagatggaactttatgtgcgcttactaagtgggaataaagaaagaggggctaatactgttggactattcaaagctaagtgttggtgagtggtttccactaaaacaacagaaagtcaagtaaggtagttgagagttagtacattaaaaaacattgagcgttcaaggtagggtccagtgattaagaactattaggttggtgtaaaagtaattgcggtttttgcaactgcttttaatggcaaaaatcgcagttattttttcaccaacctaacaaaaggatgaggataaaggaaaggatgttgagtctggccagaagaagttcactgatgaccttcaactcagtattttaataaaataatggagtgggaatcaggacatcagtgttcaggggatgatccttacagcagctcctcaagaagaaacgctccctggctttcctcctgctgtcacctttttaggaactgcctctttttctcacctccatgcaggtatcagaggacagactgtacagccgacccctaggactccccaccttcctcctttcgagtctcttgctcactcttctccttcagtgtcccagagtactacacgaattgttgctgtgttttagggactttgcttcatgtcactcagaagttgaatatgaaaatgactttcaaatataaccagattagcctttaaattctcataaaagagggaattttgcatctagagattatggggctaaactgttttgacttagctacagtattgatccaagctattagattgaaaatatcaatgggttataataaaaattgcgtgtttctagtgctttccagttgctaaatcttaacaggagggaaatatagtgacccaccttcgatgacctttttttttttttttttttttcttgagacagggtcttgctctgtcacccaggctggagagtgcagtgtcatgatgacagctcactgcagcctcgacctcccaggctcaagcagtcctcccacctcagccactgtagtagctgggactacaggcatgagccactgtgcccagccctttaaaaaaatgtctggtagacatctaaaggctctaattgactttttttattcctaatattccaaaaaacaaaaccacagggatacattcaaacagcaaggttgctaatgttcagcataatggcgacatgttcctagccctagaacagggttgttgaggattatttgtatacagtgaatacaaactaagaaaagtcatatacccataaatttgaaggccaatgatggctgataaagggaaagagaaaaaagtatgcaagttgtcacggtaatatattcactattgcatttaaaacactactgaaaacataatcctcattttttttgttttgtgaaatctcgtgagaaaaaaaaataaaggcaaatggaacccttagatgttcatttggtctcttgccatactaccagtatgatggaacaaaagagtaatttctgctagcattgtgataatccatcaaaaagatatttagccacaaaaagggtcattaacttagactgcatccaggttctttggagaaaatcactagctttccccagaacacagaacagcctttctcctaaaaattgagttacatcaaacatcacatattgagatctgccctaactagaaattgctttaggttaaatgagctctattcgtatatatatgttgtccagaaaaacttggctgaaagctggtagttctgcatatataagagtttaaaaaatagatttcttaaaaccattaaaattcttgctatatgccaagaaattttctacacagtttattagaatgaaatgttaggaatttggttttttgttttcttataaacccagcatttctttaatggatcgtatcttgcccaacctaagtccatgtacttatctcccggctctcgagaaggttacttgaccaaaactagccaagaaagatatttctgggacttctgctggagttttggaaaaagtgctcttcctctgcagggggaggctaagatagcaagatctaagcttaaagatgctggaggtataactgacagtaaagaaatagctcgcctaggaattcagccaataaaaagaaatgcacagctgagatttgaaaaggcagcatcacggtaccttcattggagcacctggatctagttagttgcacctgaagtagctgatctgacagtaatatagatttgacagtaatatgaagtaataaagtcatttttgctgttgttaatcaaatcaatttgaattgagggcttctctcacttgtacggaaaaaaaacccctgatatatttatattttctggagtccttgtaaagagaaattatgaagcgggtatcattatcccttctgtacaacagatgaagaaacagagactgaaagaaggtaaggaatttgcacaagattatacatcttgaagtggaagtactgagattcccacccaggttttttgccctgcagtgcctctcaggttattattcagatgttagtgttgaaacatggataattgcctggtttaaccactgtcctctgaggtagccacaccctgtgatctacagtgtacatttgtgccctgtgtgggttataaatagcctttggctaaatagtggagtatgtcactgggccaaagctgatgtgcctcacccaaatcttctatgattaagaatttgttctaaccatctcattttaactaaccacatatttgaaagactattgaaagggaaacctttcaatgacatcattttgaagatccaaagcatgggactacattagaagtgaaatgataccacagtgatctttccagtacttccagcatagcaatttttttttttttttttttttttgagatggagtcttactctgtcgcccaggctggagtgcagtggcactatctgggctcactgcagcctccatctcccaggttcaagcgattctcctgcctcagcctcctgagtacctgggattacaggcgcatgccaccatgcctggctaattttgtattttttagtagagacagggtttcaccatgttggccaggctggtcttgaactcctgacctcaggtgatccgcccgtctcggcctcccaaagtgctgggattacaggcataagcctccgcatcaggccctgcatagcaatttgatcagcattcttatacacgtgtatgaattaataatgatcatttcttgaggtaaaatatatgatttaccctggaacatggccaattggctaataaaattggggtctaggaggaccctgtttaggattctaagattatagtttctttaacaacataagtactgccttgtgtgcatgcatttcaaatctattttaactccagttatgaattttagagaaaaaaattatattttaaacatgttcttattagacttataaatttaatactttttatataacatgagcaatactagtacatagttcacctttctccagcagtttacacagtcaacttagtactcttcctgcttccatctcccagctccctacgatcccatagaatatgagcaaaggggagcctcagcacatgtctgctggggctgcaggagtcactctggtgaccaccactcagcctctggctagtccctgctagcctctggtgcttctatcctggaggaaggaagataagcactagtcatgcactagctggtaatattcccatcttcatacttgcaggcaataatacaaacctggaaattgggaacctgtcagctgtctggggaattcagcatctggctgagtcccctctccctcatccccactgcagcgaggcaagcaggaggtagaatttattcttccacctgtgtatagaagacagaaaatgagctgggcttcatcttttccttgttaagcttaatgggataaaataatatgtgaaaaggatactacatattcaaccttgctctaatttcaaatatcttacccagtgtagtaaaacataaactaagttcaagtattgcctctaccatagatgtgtaatcttggacgatctggtaaccctccctgcacctccacttccttacctgtaaagagttccatgataaaagtatctacttcacatgttgggaggtttaaatgcaataattcatatgaagcactcactcgcctgcactgtaagagctcaacaaatattagctacattgtaattattacttttactttgttatttaagttaaattagaatctgttgcatgccaggcactgaaattttactgtgtgcttgtctagtgaaatgtccaacttccaatagtaccatactcactgcctactgtagacatgtaactatataaaggaaatcaatcagcccccctctggtgttaggaaatatatccatttctataatcagaattcataaccaatgttatatataaaacaaatgatgtattttttgctccatggtatgaaagatagctgtaacttcttaagaaatgtacacatcacaaatattctgagtaatttcatcttcccaggctccataacaaagtcactcaatagtttgatatatcctgggaagacagcagatattttgggttttagaaataaaacatatcccacactggcatccatggctcctgatttaagaaatcaaggctctggaactgggaactcttacctgaagatgtgatcgtggcaatgataataagaatagtaacagcaaatacatcttgttgtatattaccgtaaccctaacgcaacccgtgaattaactgaagttgtaccagtagggaaatgaagacaacaaaaagtacacggccaccttaaagcctcgacatttgctctgatgagcatctagcagctgacatgctgtatgtcccaggaaaatcaggataagtcagcagaaagtggtaggcaggcagggcaaggtcttcagaagaactagttgctctagttatgagccgtgtgaactcaggcaagttccttaatccctctgagcctgttttctcaacgatgaaaacaggaaaatagttatgttacaggcccattggaagggtgtatgagaatatgccctgcatttttaatttccttttaaaggcagccccgcaactggtgagcccctgattttatccttttcaaaaacagtaaacaaacctgccccagagtaatttttcaaactccagcttaccgctaccaaataactgcagcttactgctccgcgtcgcaagtcaagatgtggctccttcattcacacacatctcttgagcgcttcccgtgtgccaggtgctatagggcacacaacagtgtggggattacagcagcgagcaggcaggtgaggactgtgctgtcatagtgttaaactcatcagctgacacagtcgggacttgcagcaagtaaaatacccagtttttcaagcaatcgattttctctcgatcctgcactttgttttgctctttcctttatctagtaccagaatgtcaaatcaataaaaagtcgagtgaagcctttatttgtccaccaacctcagcattagtttaatgtttatattctctccttgtctttctcacttggacaattctcaagcctctattttgctttccagttacattctggcttcatttttttttttttttttttttttttatggtaactgcctccgagcttggcttggtcacactttctatgtagagtcctttggggagctcccccgcctggcctctgtctgtaatatcaccaaaggcagtaatgggctttggcagtgttttgcaaagaccaacaaagatgaatatcattatactgaggtccatgaaaccaagatcagattttttttgtgaatggcaagggaaggcagactgcacaagaacactgaagggactgaactcttcagcctcttgcatatttatcacatgaatttggcaactcatacatggagagaatgaaaactcgctccccgaacaagtgaggaaacattcatgaggaaccgaatggggtcgacaggtaagcacgctttgcccatatttgacttgtggagagtctcttcagtttaccaaccttgctactcaaatgagcacattttatatgtacctaatttttgtgcaatggtttactgtaaagaacatttgcagcatatgaaaggggcctggtcgtttattctaaggttatatgagattatgttggaggcattccttgccacatatgaacatctctagaaaggcagcattgcctctggaggaggagcaccttggtttgaatcttaactctcctacttttcctcctgtgacctcgggaagttaattaacctttctatgcctccatttcataattcgtaaaatgcgaatactaataataactatctcaataggttgtcagaatgattaaatattaaatatgtcagtacttaaaagtatttggaataatgtctagcacatactaagtgctttataaaaatttgttaaataaataagttttgaaataacaaaatatatgacaagtaaaaccaactgttgaagaccaagttggaagatgaagcctggtacgtagcttggtgtaagaaactccaataacatagctatatcctaagtttaaatatgaatggcctctcattacccacaagaaattaaaattcaaaggaatcctgagcatgttcataaaagatatattcatattaaccaaaactgaaaacaactcaaattttcatcaagaggaaacaaactaactctggtacatttacataacataatacagtagaacaataaaaggaataagctacgaatatgtgcaaaatgtagatgaatctcaaaaacttactttgagcaagagtacgttatatgatttattttatatgaagtttaaagtcaacaacataaatatatgactattgaaattaaaggacattgctgcgggggataggatgagttggagatttgactagaagaggaaatgtggtaactttccaggaatattggaacatcatctgtctttcagtgatggtaacatgggaatacacatttgggggaaaaaaccctcaacaaatttttatttaagatgtgtgcaattctacactgtgtaaattatactgcaattaaataaaaactatattgcaaagataaataaatcttcagttctggtaacggcaggctagttaattcagaacaaacctcccattggagacaatgatttctagatgaaacattaaaccatgcttctagttgcatctaaaagctataaagaaaatgagaaagcatcagaccaagaatccaggacaaatagaaaatccaaagaggagagcatggactctgggaccactttttttttcaggtgcctttttattttacttttttatttttattattattatttattttattttaagttctgggatacaagtgtagaacgtgtaggtttgttttacataagtatacgtgtgccattgtggtttgctgcacctatcaacccatcatctaggttttaggtcccacatgcattagctatttgtcctaatgctcttgctccctcaccctccaaccccccactggccccggtgtgtgatattcccctccctgtgtccatgtgttcacattgttcaactcccacttatgagtgagaacatgaggtgtttggttttctgttcctgtgttcatttgctgaggatgatgcttccagcttcaaccatggccctgcaaaggacattatctcattcctttttatggctgtatagtattccatggcatatgtgtaccacattttccttatccagtctatcattgatgggcatttgggttggttccaagtctttgctattgtaaatagtgctgcaataaacatccatgtgcatgttctttatagtagaatgatttatattcctttgggtatacacccagtaatgggattgctgggtcaaatggtatttctggttctagatccttgaggaatcaccacactgtcttccacaatggttgaactaatttaaatttccaccaaaagtgtaaaagtgttcctatttctctgcagcctcaccagcatctattatttcttgactttttaataatcaccattctgactagtgtgagatggtatctcattgtggttttgatttgtatttctctaatgatcagtgatgttgaacttttttcatatgtttgttggccgcataaatgtcttcttttaagaaatgtctgttcatatcccttgcctcctttttgatggggttgtttttttcttgtgaatatgtttaagttccttgtaaattctggatactagacctttgtcagatgagtagattgcaaaaattttccccctttctgtaggttgcctgttcactttgatgatagtttcttttgctgtgcagaagctctttattctaattagatcccatttgtcaattttggcttttgttgccattgcttttggcgtttttgtcatgaagactttgcccatgcccatgtcctgaatggtattgcctaggttttcttctagggtttttatggttttgggctttacatttaagtctttaatccatcttgagttaatttttatttaagatgtgtgcaattctacactgtgtaaattatactgcaattaaataaaaactatattgcaaagataaataaaggaaggggtccaatttcagttttctgcatatggctagccagttttcccagcaccgtttattaaatagggaatccttttcccattgcttgtttttgctgagaccacttttgctccaggaacatttgctatgaggaagagatggcagggagataaagcaatcctcatacagtctcttcaggaaagcggaaataaaagttgaagaaacaggcctaccaagattgaggaccatagcaaatggaatgctgaacacttagacttgacatccagaagagctgaaatctagcagtaagaatgagtaagccagaagtacatgagccccttcaatgtctgcatgggcaataaaattttaatccttgaaattggattaaggtgattcaagattgctagtgcccataggcacctaacaaaaagaaacaatgctctctggaggaaggtaatgttctagggcctaaatttttctatacatgtttttcaaacagggttaggattcattcaaaaataataaggaaacacacagaaagacacatcaatatgaatgagaactagcacaaacagatatagacccataggtatttcagatagtgaagataaatttatttagtattttattaagctcacaaagatagaagtcaaattttaacatttcagcagaaaagtggaatctttaaaaagaacatcacagatttaaagcaaaagaaaaaaatgaaaatgaaaagaaaaagagaaaccctagaactagaaaacatagtgtctaaaattagtaactcaatggttgggtgtatcatcagcagatagatgtaactcatagttagcacctctgaagatgtcaggagaaactacccaagatgaaagagacggaagcaagaacaggaggaattgaggatataattagaaaacctaacatatatttaatagaggtcatagatttaaaaaatggccaacagcaaaatttgcaaatgtaatggctgagaattttgcaaatctaatgaaagctatcaatccacacattgaagaagcccaatgactcccaagcaagctaattaaaaataaaaatctgggccaggtgtggtggctcaggcctgtaatcccagcactttgggaggccaaggcgggtggatcatgaggtcaagagattgagacctttctggccaacatggtgaaaccccttctttactaaaaaaagaaaatacaaaaattagctgggcatggtggtgcttacctgtagttggagctactccggagtttgaggcagaataatcacttgaatccagaaggcagaggttgcagtgagtcgagatcgtgccactgcactccagcctggtgaaagagcgagactccatctcaataataaataaataaaaaaataaaaataaaaatctgggctgggggcagtggctcatgcctgtaatcccagcactttgggaggccgaggtgggtggatcacgaggtcaggagttcgagaccagcctggccaagatggtgaaatgccatctctactaaaaatacaaaaattagccaggcacagtggtgggtgcctgtaatcccagctacccgggaggctgagtcagaagaatcgcttgaacccgggaggcagaggttgcagtgagtcgagacagtgtcactgcactgtagcctgggtgacagagcaagactccgtctcaaaaataaataaataaataaaaaataaaaatctgatatatgctgaggaggcggggccaagatggccaactagaagcagaggccgtggggggctcctatagaaaaagaaaaaacaaggcataataaatgtgtgaagccttcactggcaaccaaggtatccaggttctctcatcaaaattgactagaaggctggcatgacccacggagagaaggttagggttcaagtgattctcctgcaccatcctcccaaatagctgggattacaggtgcctgccaccacacccagctaattttttgtatttgtagagacagggtttcaccatgttggtcaggctgttcttgaactcctgaccacaggtgatccactccaacccaaatacccatcaatgatagcctggataaagaaaatgtggtacatatacaccatggaatactatgcagccataaaaaggaatgaaattacgtccattacagagacatggatgaagctggaagtgatcatcctcagcaaactaacacaggaacagaaaaccaaacaccacatgttctcactcacaagtgggagttgaacattgagaacacatgaacacagagtgggaaacaacacacaccagggcctgttggggggtgggggggggtgaggggagggaactcagaggacaggtcaatgggtacagcaaaccaccatgtcacacgtatacctatgtaacaaacctgcacgctctgcacatggttcccttttttttttagaagaaataaagaaaaaataaaaataaacaataaaaatcttccttgtcaagaactgtgaagaatgtgagactttacactatttgtaatctagtaagttaggctgccataattttgtggctgttaacaaaacacattagcctcctaggtcagccactttatttcaagtcacaggactttattattcatggcacagcaagcagcaagagtatagtgtttgcatcagttcctcttgcccacagggcaacaacaaagggatgaaactattgtatgtgccatgcatgcagtagtttcatgtcatggttcaggaactccaagatttaggaacccagatcttttatagtgggcagtaagtttacctacactttaccctggaggaagatcactacgcttattatgctgaatggtaaacaaaacaagcccaccctctgatccaaacacatttacctccatcttccaagctatatgctatacaaatatccttgaaaggataagcctatataaaaaaggcagcaagccccttttcacacacacaaaaaaaagcacaggcatacgagacccatggagaactgtctgccaatcttattcactcctttttacaccatcttggcttgtaataaattttcccattatgtccactgatgtatcaacttttgtgactaatctgatcaacagaagctaagatcaaatatattcaatttgttttctacagaacataatgaagactactgttaacaggactccaagcaataggatgaggacagcctagagtattgattttaaccattcctcccagagttctggaccccatcagctgaacaattcccacaaacaaattcccacaaacctgccttccagtgctgaggtttcattgatcactttagctaaagttcggggcaaattttgcatcaccctttctaattggaggactctcattgtagaaatagttaccctcagatatgcataaataatgagaaaaattaccctcggagtatgcaaaattgctctggggagaaatttcaggtaatcaagaatagcttcattttggagagatctttgcagtcatctgagggatacatgatctattggtggtatttttctaaatcattctttaggtacaatcctcttagttttcaggaggaaggcaaggttatgaatggcttccacacaaactgtgcaaccccatgaattctcatggtgtcctcagaaagtattgttcgaactgttgggccactctaagtgataggtacattatatggggatggaggaacacaggttgacagtgcctctaatgtggcttcctattggcgttaggcttcccagtttaattttataattgaatctagtccttattttggaagggactgcctgagagcagtcagtgcaacttgtccagtttatccataccatagctggtgacatttgcccactccatggaaaaactgcttgatggctcagtgtggggagtgcagaagacatctggagacattgacaaggaggcaggaactgagccatctcctgctgtttccaacagaatttatgatatggttaaggagaatggtggtcaaattttggttagagcccttaggctggagatgccagacctattaaactgaaagctgcctactacggtttgaaaagtctgcaacaggccatttttctttttcttctgcaacaggcctttccttcataaggaaggcactcagggcagatctgaaggggaaagatcattaatgtctctctcttcctatacctcccagggtctaaggtgttcactcttcatgtttccaggttgcagctattccaatagctcaatctttaccttttttccaattatccactacatacactcagaccttttgtccagaagggtctgatgcaatagatagaaagggatttttataaaacagggagacccattatatcttcaagtttagcctctgtgggccattgtagtgggacttgacaagcagtgttcacaaagagtcatcattattcttgtcatagtctgattgtgttgcaataatagaatacctaggtaatttataaagaaaagagatttatttgtctcatgttctacagactgtgcaagaagctggcatgagcatctgcttctgctgagggcctcaggctgcttccactcatggcagagaagagaggaggcaaaaaagggtgtgagatgccagactctttttaacaaccagctttcctgggaactattagattgagaactcactcacccctttccccacactccctgcaaccgggaaggcattaatccattcataaggaatccagcctatgacccaaatacctcgttaggctccacctccaacactggggatcagtttccacgtgaggtttggagggaacaaaagtccaaattacaggattcctcatgatctatgaacatgccaatcccccccaaaattaacccatgtggcttaaatttaaatcaccaggagccctttttgatttggctgccagcagaaaggtgtacttaccaggttggcctggattgctattatgggaaaagaaaggtgcattatgcccagaaatgctcagggcagaatccccagctttcaaaacacatctatgtcactccccacccctttcattctgatcattacccaggaggcagatgtggatgtcccttttttggaaatagccacattcagtgaccaatctgccataccacagtggatcaggaggagaggagggagataaagtcagaagtctttttttacttttatttttactttttgagggagctgttccaaagctcaacaatatccgacgcgtggaagcatggaaggtctgtcaagtaccttgactatccatgcactgctgaggagctttgataaaaagcacaccattgtcagactgaaaataatccagaaagctgaacacagggcatagattagcttcaagggccacaatggttagctgactggattgtgctatggtttgaatgtttgtccctcccaaaactcatgttgaaatttaattgccaatgtaatgaggttgggaggtgaggcctttcaaaggtgattaggctccaagagctccctgtcattggtgggtttaacaccttaatataaaagctttcaggagtgggctccctctcttggtccttctaccttctgccacatgagaagtagcatttctcccctctggaggacacagaggggagatataaatttctgtgagatataaatttctgttcattataaattacccagtttgtggtattctgttgtaatagcaaaaatgggcaatgtactaagatagattggaaaaaacatttcacaaatagaaaatgttaatggcggtgaggcaccactgatagctccaggagagggtcaaagctctgacatagtctgccaagagtatgtagggccatgccccacaccatgcagccttacttatgggagacaaattagacaccttctgataggagtcccacgtatgaggcagtggtagcctctgcatcacagtccccattctctgatggcagcagtctaatgttgccatgttcagtgtgataatgaatctaggaaaactgagtggtgcagattcagtcagcagcttgagttagtttcatcttactggtctcatcaggatgggcccttacaggcccatgagtgacccagatggttcatttggtatttgtgatttgtttccatagtttgtggcccctaaatgagtatctttaatttgccagtatgaagttttccaaggggcagaccaaacagctaggctattggcaacagctcaagaatcagtaaaaatagcttcatccaggggagggccatcctgtcctggccagagttatgagaatggaactgaattatacccatcgaatggagtaaccacgttcattttctgttttgcaccattggcactgaggctgaacagcccaggcagcccaacggatgccatatggtttgtgtttagccaaactgtcagtgaaccaggcccaggcacttagttgattatgaaaataaactatagctacacaaatatgacttttacaaacatcatgttaagaaaatggtttccccataccaaaaaagaataccatagaatttcatttataaagttcaataaaggtaaaagtgaaccattgtgtttagggatacatattttggtgctaaaaaccattctagtgtttaccaggttagtgattatctttggaggtcaggaggtatgacagggagggggccatgccctatttcttaaacttgaatgatcactttataataatttgctaagatatatacttgttttgtgcatatttcaatatattgttaactttcaaaatttcttaaaggggatgaatcccttagcatgttaacatataaaggagttagagtccaaaatgaaattcacttgatcttgtgagttaccagagtcaaataaatcttaagctaaattaagatccaaatatgattttcctaatttcttattctgctcaggttcagtctgagggattctcaggaaatggaaagagttggaattcctgcagccttcccagccttgttctcatttgaatgactgtaataccattagggcatcaaaagctgcattcactcaatgccaggtctcttgtgttcctcatttatcaaagtgtccaaagagatacaggacatataagattatcagcagccctggccccatacccaacaaatgcagaaaacaagccaatcctctgctgatggcaattatcccaggaaaaattacattcctaccacccagtatcagtgttgccaaaagccaaggtagaaactcagtagtatcaagtgtaggagggtggatacacaaaaaacaaaatctgggttgtatcttcaccagattgtctgtcaaaagatgccaaattgtacagcatctacaattgtgaacttaaaaggaagaaatttctcagcaagagcttaattcgagtactataaatttaccatatctggaaaagaaagcccacctatacataatctttcctctttcagagagtggtgtttgtgactaaagtctttttgcagagatttgaatgcaatgaagacagttccagtcaccagtcttgtttaaagttcctttcttccttcctccctcccttccccttcccttcccccttcccctaccttccttctttttctttcctctttcttttctcttcctttctttcctttctttctcttctttctttcttgcttgcttgcttgataaggtcttgctgtgtcacccaggctggagtggcagtggcccaaacacagctcactgctgtcttgacctcctgggtgccagtaatcctcccaattcagtctcctcagtagctaggactacaggcatgcaccaccatgcctggctaatctttgcattttttgtaaagacgaggcctccctatgttggccaggctggtcttggactcctgggctcaagcgatcctccctgtgttgggattacaggcatgagccccatgcccttctaaatattttacttcccaaccagtaaaacatcataatttctatttcccttttgagcctctatttctgatactaaagctttatgtgtgagctctagaaggtaatatggcctcctgagaatctggtaaccaatcatttttagtcttgtgcctcagaagttcctgccactgtcttttcttacggaactgcttaggtttaagaaactagtattgagaggaagtgttcaccaagttctccgcctttggttcacctagaaaatcgccctcaacaaactcctgaactgaagctgcattggggaattttaatgcctgctccctgagagccctggggaggccagtgtaaatttctccagctactatcttttcaccacttgaattctacaatcatctgaaggatgttccttcaatctgggtggtgcaagtttgaccagcagcttggttcattccctctatgtcacttcacagtttatctattgattcttccagtatttttatatttgatcccacagatcagccacatgaattcaaggttattgttccacagtgcatcttgcacctcagtgcagaatctggggcatcccaattttaagtgtggaatcttattttgctattgtttggtaggaacaaagctgtcagctatcctgtcctgtaaaagcagcagatacattctgtgtcctaacatctaaaagttctgtatacagaaagaccttcccctataatgaattcctcattccctcttgtgtcacactagcacctattgaggcccttcgccctggaaatgtttgccaagtgtaccctaaggggaagctgtagcaacctgtgccctgagcaaccttgctgatatccttacagctctgcttcagagagatgctgtacacgtgctgttcgcttagagcttctcacgcttgtaattcaaccttcattagcagcggccactcacccatggacacagcagagtgcccataaggtgcatgcacccatcagaccaacatccacgtgaaccattttactaaggtcagagcagttaaaagccgactgcaccacggtaaatggctgaccagactaataaaagcctccacagggcttcaagaaggaatgcaagtatgacttttgtgggccctgtgcacttttgcctttcaaagctcctttcatgaaaaattctaagaagctatttaaaaatattaaaagttacgttttacatttgcattggtataaagaacacacccaagctggattatatgtatttcttttcttcagagtttaaagacatgaaaacctttttgtgggcccctgaaagtgtcctttgtaatgggccttcggcattacgcctactgtgactacagattaagtcagccccagcgccaggtcaacatgccctgctcacatgaaagtctaagcctgaagcccaggctttaatcactccacatggagttttgttctttataacgtatttctcagtgaacctggccaatgtaacaaaatggtgatgttctgagggaactgaataaataacaccttgacactcccacagaaagaaggcaaataagatgagaatcaaaatatcacctttattactaatagatgctagggtgaagaataccatccatttgactcctacgtttattatataattgggaaggccaggcacagtggcttatgcctgtaatcccagcactttgggaggccgaggcaggtggatcacctgaagtcagtagttcaagaccagcctggccaacatggtgaaaccctgtctactaaaaatacaaaaaaattagcctggtgtggtagcaggcacctgtaattccagctacttgggaggctgaggcaagagaattgcttgaacccaggaggcagaggtagcagtgagccgagatcaagccactgcactccagcctgggcaacaagagtgaaattccatctcaaacaaagaaaaaaaaagttgggacatgtatcccccagtcgcaggcaacgctggactgaagcagattgctccggaaggcacagaaatgcttgttcctgcagaaacagcagagaatgccccttcctgataagaatctagctcctacaagagaaaatatgaaatggagaagctgaggtgagcatatccatgttgttctccaaagacttgtcaatcagattaatcactgtgtgacagatgcatctgacagcaataagttaagcataccctgagaatgaccctatggtctgaggtaagaactcttgtgtcttatctatgaagaacatttgaatccctggcccattccatggagtgcgggctgtacaggagatggaggccttttgttttgtgttgaatgaaggttgccaggaggagactgctaaagagagggtgatgggtgaaaatgctgtaaaaatcgcatgcttttcacaagtggctgcacttctcctgtccagcctgcccccactggtccaacctgtgtgtaaatctcttcagtaaaccctacatctcattcactgactctgggtttctttttcagcctctcaaacatagtgctatccctattgaagtcaatggggatctggcacaaaagtcacttgatgttggggtcaggaaagagaggaagtcaataaagtagtggagagagacaccaattgagtctttatgcctaggaaaagcatcagctcagaagatgcattcctctgaaaagaggccatgttaaatggtaagaacatttaggggcactcaaacgacggtcagaataggagaggaattatgttcaacatcattttgacattttaagtgtcttctacaagcagaagaatgaatgaatgaaactaaagttttatgtcttatactcaataaaccaacaatacttattgaaatggctatgcctaaatcttataaaaagaaaggtgattaaaaactttgcagtattttttttcaatacatgtactagaagaataggcattcattcctggtagagttcagtaaacaattatagtatacataagaagaaaataattccttgcacttgagtttctgttgattagcagcactaaaaataaacaaagtagataaaattctttaatgaaattatcctctactgttacagaagaattctgatctaattccattctcaaatctctatgacattcactattcagtcaaaaaatatgcattaaggaccttctatgcttaactgagaatacaatgataagcaacacagtttttgtctttatgggatttacattcctgcatcttaaaacaaaaggaattcaaaaggctcatatactgaaaggaaattatattcaagtttttacccacacttctcccaatgataagcaaaaaacccaaatattacttgtaaaaaaaatgaaaagacgaagagtagcctttgaattcctggaactacaatgacaagtaaaaatgacctatatatttgttagttatgaatcacacgcattattgctaactcatttttctcttttatatgctatgtgtagatacagcaaggaattgccataatatcaggtcttagtcagaaagaggcagctttgttcaatggtagtttaattggaatacataatcgcacaacatttggaaacttttttattttaagatcttgaggctttttgcttgctcagttttatctcatgataatctactttattaattaacttccagcttggccaagacacatttagtcttaatggagtgttgatttgtgtcatcaataaccttctggcgaagtttgctaatgaaatttatgttatgggccctgtataattgtgtgaggtgaccttctaaggtgattatcatttaaatttacttcaaccagataccctttccaataactacacacttagactttctttgtaatccatttttttgttgtttttccattcttgtccctgagcaacacattggtacctgtttttgatttacttattattattatattaaaggtaataatgttgtgcttttccagtaagacagttgctgtaacaattactgtccttttaataactacattaagcttgctttgatacattattcatcttagttatgtattagtattaattatgtagttgccacagtatgaccaattcataatcaacctgatctatctgaactgggtgatcatgaagctcccataatgcaaaagcacagtgaagatttttattacttcattcaatatagacttatcaagcacctactctgtgccagaactatattagatatcagaaggacaagtgtcagtaaaacaggtttcccttttttcacggaccttatatccttgtgaagaagtcatataataatgacttgaaagataaagactgatgattgacatgtaggaaataaatgcagtgttgcaataaataaataacagtgctgacccacaattaaggaagcaaggacatatttttggaggaagcaatatttaagcagagacctgaagactcagagacagagtgccagccaaataaagagctggggaagagcattccaggcacaggacagacagtgcaaagatcctgtggcagtaaaggatttgagtttcctaggaactgacatatagaaggccagtatgcctgaagtgtgagtgagggaaggtgcttgagaagtgggcagggcccactgttttgggccacatgtgatcctgtgatgcaccacccagatttccccacagaactgaagcatttattctcccagctgctagtggtgctgcctgctaacttccttcagctgtcctctttgcctttcatggcccgaatcaacctctcaaagacttcttgaggaacccaaactgcaataccacagtaagtacatcggattttacactaagttaagtgtgaagctatggcaaggctttaataaaagcaagcgaggatcactttgcctgatatgtgtagaattagggcagaaaagaatcagacgactggttaggaagctattgcagtaatcccagcgagatgatgatggctggaactagggtaatgggagtagaaactgagaaaagtggataaatacaagatacatttaggggtagaattggtgattggctagtgagagaaaggaagtaccaaagaataacaccaaaggtatggtgcaacaacgttttagatgtgcagcagcagaaaatgtagggcacctgaattcaatactgctttatgaagcttgaataagtactgagaaagacccatgcttaacattctgtgaaataatattttgggttcattttagaaattatccccaaagaaatgtgtgatcagcatgaattaaaaaccatggccacaaatgattatgttatatattgtagttttttatactcaatggtgtttgaaaacaaataattgcaaactcatcactatctggcactttgtagctaagctgagcttaaatattgtaaactgaattaatgaacgtaagagaacatggttcacagttcttatgatgcattagcttggtctcagaagtcaataatggcttgatattccagaaaacagacttgtactgttaagtctaaggccacaaaatcatttttaaataggtattatacaaagtcagcatttgtgaatggctgtggaataaaagagagtagaaattaaatagctccagaaaaattaagagttatttttagagtaggtttgcactaacctaagatttttaaaaaataaaataaaataaagctctcgtttaacagctatttttcactcagattcctgatctaacatattgtgtatttcacgcgcgtccgtgtgaagagatcaccaaacaggctttgtgtgagcaacaaggctgtttatttcacctgggtgcaggcgggctgagtccgaaaagagagtcagcgaagggagataggggtggggccattttataagatttgggtaggtaaagggaaaaagggggttctctggcgggcaggggtgggggggggtcacaagatcttagtgagggagcttttgaaccaggatgagccaggagaaggaatttcacaaggtaatgtcatcagttaaggcaggaacaggccattttcatgtcttttgtggtggaatgtcgtcagttaaggaaggaacgggccatctggatgtgtacgtgcaggtcacaggggatatatgatggcttagcttgggctcagaggcctgacattcctgtcttcttatattaataagaaaaataaaacaaaatagtgttgaagtgttggggcagcaaaaattttggggggtggtatggagagataatgggctatgtttctcagggctgctttgagagggattatgggcggcgtgggaacctagagtgggagagattaagctgaaggaagattttgtggtaaggggtgatactgtggggttgttagaagaaacatttgttgtgtagaattattcgtgatggcctggatacggttttgtatgaattgaaaaactaaacggaataagagaaggagaaaaacaggtattaaaggactaagaattgggaggacctaggacatctaattagagggtgtccaagggggttcagcgtaattacttgcttggttggcaagcttttgggctctatccttgagttttttatgttgtcatacaccaggccagattgatttaggtaaaatgaacactcttcatttaagaatatacagagtcctcctttttcagcagtaagtcaaggcctcggcggttttggaggacaactgcagctaaagagtcaacttgggcctggaggactgataaagtttgtgatacgtctgtgatgctagcagagaagtcattagagaggctacggaaggtcgtgacagaggttgaaatgcctgctattccagtaccgagagcaatagtgaaggcagaaagtcttaaactgacaagcaagggaattagtggaataactcttttttgtcgtgtcggtgtcatgaggggaacagggagctcttcggtcctatttgcaaattgaattttgggagtaaggaaaactagtgtgcatgtgcctgtccaattagcaggtagacacatgtaggtagaggatacacagaggaagaagacaccttgtgcgaggcaaaactggagatgcaaagtaaaaagatgagaaggagtgctgaaaggggtgtcttgtacccagactcctagggatccagctagggccacagccatcagaggttgtaatggggactgatgaggtaactgcacagaggaggaggttcgattttcatggtgtatgagaaaacgttgagtatctacgagcaacctttcactgttatttacagggctgggtataagtaaacaagaagagggctttggagatgaagagtaaaggaacatcgagaaggtgaaaggttacccaggggaattccagtggccacaggaatagtagtttgtgttgtgagaggtctaaatatggggggagtagagttgatataaggagaaaggtttttttaagtaagtgcggaggagggcggcagcttgctgatgtgaaatgtctggggaggtcttgctggacctgtctagaaagtaaatgagttcttcaggagggtaaaggtgagggctgttaaaggaagttcagaggtgtagggagacaggagatgttgcctaatctgcatgtaagtggggacagctgtgtaggcgctggaagaaagggaaatgcaaagccagcggttgttagctaaggaaggattagaaatggctaggagagaatagtaaggtcgatagtgtagtggagatagctggggagaggtagagggtggcataagaatgggaatgagaataagagtgagtataaaagtaaagaatagaacttcatcagggtgaaagtattggagggtcccctgccagcaaagatcatctatccactttaagagggagttaagagttgccagtcctgggtcgggggtgggtgggcaaatcctcgagcttgatgtgtagggaagggagggggcctgaataatccctgaggagtagtagaatagcagatggaacgctgagaagttatttctttgaggatagattcccacaatggaaaggaaatgagaggttctaaaaagcgggctggtggcttgcattatagcatagcctgcctttgctggtgtgtggtgattaggcctggtgaaactactatcaataaaccaaatgtgatcagggtgaggaatagggaagaaggaaatatggggaaatggggtgaatgtcaggtggatcagagcgatacagtcatgggggtcaggtgtggtatccagaataatgtgggaggccggattgaagtcgggccaggaacaatggtaattgtgggagactcaacaaagagtgagtacagctgaaggaggcggggagcagaaagtatatgcatcaggtgtgaggaagaaaatagattttggaagttatgagaactgtagagagtgagttgagcataatttgtgattttaagggcctctaaaagtattaaggcagcggcagccactgcacgcagacacgagggctaggctaaaacagtaaggtcaagttgtttggacagaaaggctacagggcttggtcctggctcttgtgtaagaattctgaccacactaaccatccctaggaaggaaaggagttgttgttttgtagaagggattggggtttgggagatgagtcggacacgatcagcagggagagcacgtgtgtttttatgagattatgtcgagttaggtaacagatgaggaaaaaatttgggcttgactgaagtagtgggggctgtctgtgaagtcttgaggcagtacagcccaggtaatttgctgagcctaatgggtgtcagggtcagtccaagtgaaagcaaagagaggctgggatgaagggtgcaaaggaatagtaaagaaagcatgtttgagatctagaacaaaataatgggttatagagggaggtattgaggataggagagtatatgggtttggcaccatcgggtggatacgcaaaacaatttggttgataaggcgcagatcctgaactaacctgtaaggcttgtctcgttttaagacaggtaaaatgggggaattgtaaggagagtttataggctttaaaaggccatgctgtagcaggtgagtgataacaggctttaatccttttaaagtgtgctgtgggatgggatattggcgttgagcgaggtaagggtgattaggttttaatgagatggtaaggggtgcatgatcggttgccaaggagggagtagaggtgtcctatacttgtgggctaaggtggggagatacaaggggaggatgtgaaggaggctttgaactgggggaaaaggtggcaatgaggtgtggctgtagcccaggaatagtcagggaagcagataatttagttaaaatatctcggcctaataagggaactgggcaggtggggataactaaaaggagtgctttaaagagtattgtcaaagttggcaccagagttggggagttttaagaggtttagaagcctggccatcaatacccacaacagttatggaggcaagggaaacaggcccttgaaaagaaggtaatatggagtgggtagcctccgtgttgattaagaaggggacagacttaccctccactgtgagagttacctaaagatcggcatctgtgatagtctagggggcttccgaggcgatcaggcagcatcaatcttcagttggtaagctgagaagattggggaaggagtcagtcagagccttgggccagagttccaggggctctgggagtggctgccgggtgagttgaacagtccaattttcagtggggtcctgcacagatgggacatggcttcggaggaatcctgggctgtgggcattccttggctcagtggccagatttccagcacttgtagcaagctcctgggggaggaggttctggaggaacccctggcagctgcggttcaggcgtttggagttcttgtgtgctggagatgtggctggggtttgtctcacagtgcaggcaaggaattgcaactcagaaatacattgctacttggctgcctctagtttattgttgtacaccttgaaggcgaggttaattaagtcttgttgtggggtttgagggctggaatttaatttttggagttttatttaatgtcgggagtggactgggtaataaaatgtatattgagaataagacggccttttgaccttttagggtctagggctgtctcagcattgctgccaaacgagccatgaactgggctgcattttttatttgatgaaaaagagcctaaaagctatctgatttgggattaagaaaaaggagcattaaccttgactatgcctttaactctagccacctttttaagaggaaattgctgggcaggtgggggagggctagtcgtggaacgaaactgtaagtcggaccaggtgtgaggaggggatgtgacaaaaggattatagggtaggggatcggaggctctgacctagctcggcctggcaagaagcagcctggggaggaggggagcagtcagatgggtctgtagaaaaggaagattggaaagaggaaagactcagtgatgcttggggttgggacgagaggacagacaggagggaaagaaggaagatttgggatgagctgcattggaaacagagactagggagggactgatgtgtaaaagaatgcctggacatcaggcacctcagaccgtttgcccattttatgacaagaattatttagatcttgtaggatggaaaaatcgaacgtgttctggctatttggaaccactgtcgagtttgtattggggtcaagtggcattgcagaagaaaataaggtgtttaggttttaggtcaggtgtgagttgaagaggtattaagtctttgacttaacacaggctaagggagaaggaggaatggagggtggaagtttgcctatagtgaaggaggcaagtccacagaaaagagagggtagagacatggagagaaggggtggggagtgtttgccccccaggaaagtggagaaggggtagagacatggagagaaggggccggggggttcttgccccgtagaaaagtggagaaggggtagagacagggagagaaggggtcggagggttcttgccgcccagaaaagcggtacttgccgctaagggtgaaggaccaaggcaggcgtccccacgtggtcagacacctctgaaatgtgggtgaataatcagtcaggcatctctgcgtgattaaacaccaagggaagactgtcttcccgagtctgtgaccagtgccggagtttttgggtccatggataaaatgcgtctcctttgtctctaccagaaaagaaaaagaactgaaattaagagaagggagagattgaagtgtggcgccaagattgaaaggagaaagaggttgagggatagtgagagaggttggagaggagagtaaaaagaggccgcttaccggatttaaaattggtgagatgttctttgggctggtcggtctgaggacctgaggtcgtaggtggatctttctcatgcagcaaagagcaggaggacaggggattgatctcccaagggaggtcccccgatctgagtcatggcaccaaatttcacgtgcgtccatgtgaagagaccaccaaacaggctttgtgtgagcaacaaggctgtttatttcacctgggtgcaggcgggctgagtccgaaaagagtgaagggagataggggtggggctgctttataagatttgggtagataaaggaaaaacgggggttgttctctggcgggcaggggtcgggggggtcacaaggtgctcagcgggggagcttttaagccacgatgagccaggagaaggaatttcacaaggtaatatcatcagttaaggcaggaaccggccatctggatgtgtacgtgcaggtcacaggggatgtgatagcttaacttgggctcagaggcctgacagtgtatactttgccagtgaatgttactggttatagagattagaatccatgcctgtttaagcagaaagggatttattaagagatattaggaagttgtccaatcactgaaagtacaggtggggcaaacctaggttgacctaggaactgctcccaagaccaaataatagaaattgcctgttgggggagaggctaactcatctgactttaaacttacgctgcctctaccataatctagaaagaaccattgccaccaatgaccacccaaactatgctgcttctgctgtgattccagaagcacttcacttacccttaaactcagaaacacccatgcttgcaaatatggatgtcatggcactattttgccaagcagttgatcaaatcaaaggctcattaagctgtatctgattggtgaactctgtcacatgtttgtactcttaacagcaagttgtgctgggagatgtagttttttcaattctgtgttggggaggcacaatgcacaatgtgggaaactatcaccacatggggaaagcattgagaaaaaaatcttccacaaataatagacatgaatgacagaggtccatcatagttaatattccaattttttttttttttttttttttttttttgagatggagtctcgctctgtcgccaggctggagtgcaatggtgctatctcggctcactgcaacctctgactccctggttcaagcaattctcctgtctcagcctcccaagtagctgggattacaggcacgcacaaccacgcccagctaatttttatatttttagtagagacggggtttcaccgtgttggccaggatggcctcgatcccctgaactcgcgatctgcccgccttggcctctcaaagtgctgggattacaggcataagccactgcacccggcccatttcaaaatcttcactcatggttaagttctattaatatcattaatataccccattttccactggataatacatactgaccactgaaataatttttagaaaaatttaggaaccaaagaattgtatacgcttgatttagaatgttcctcatgaataatgagtattgaaatctgcattaatatcttcagtaatgaatctaccccgtttttagcaaagtcagatattaaaaagattttcaacaaaactataattgattatttgagctcaccagatagggttgctgcttaagagacttatttatagcatgttagatctaaaactgatagtactttaataattccacagagtcctcaaataactcactccaagataaatcagagacagcgaggaatcttttcattggatgtgtctgggcaccatccatggtcagcaagctcagtgtgctggagttcagggttttctattttgtttctacagttaatttgttagcatgtgaatttcagaattaggtggactggcatcagtccttccggtatcttccaaagcaagtttttgaatagagtatctactagagtttccagtacagggctctatttgaatccttccaaaagttgtagagattttgcctgctcttgttcaactttctttcaacagcttctcttctttattaccaagagtctttgtgttaggcagcaatacaacagatggtgaacaagtcttcatcaaagcaatctttttagaaacaaaatccctttagcataatgaccctaaatcagatctaaagaaaaaattcaatggaaacgttgtaccagtgtttcgtggcctacacaacagactcctactctttaacatggttggcttaattgaaaaatggttagtttttgttttgcccagtctaatactattgcacttatgaataataattctattagcatatatatatatgtttctaaatctaaagtgtattatttaattctcataacacagtgagtgaacaaaagcattgtgtgggctgaatgtagactacaaataaaaatggccatttagattctaatattacattatctaaaaagttaccttcaatcatttgcaatcattaaatattttacttttacttaggcaataatgacattccctaacagataattcttctttggaggtctctaccaaatagctctacttaaaatagcagagctgagtcaacatctcagaatgcattatgattgcaggcagcaaaatgactcacaaaatggtaaacatacgaagaagccaaaccttcactttaaaagattaatgatagtatacaacaaatgacaaagtaagcatctatctctactacctcttacctgggagtatttctctggattctaaataagcattccatacagatattctgtaagtttatatgaagaatttatatgctttgattgtgcctactctttttcattgtgccacaaagctgttgagctttatatagaacttcagtttagtgcatttatttgtcaagctataggtgtaaaaaccagctattctagcatttacctcattcattcagcttcctattctgaagctttccttctgagatttttcttcaccatcttacctctttttctttcttcatatccttggtataaaaatgtgaatagttttcagctagaaggaaccagcaaagaggtcccctaggtttcatctgtatagattactggtaagtttattacgtctaagagctagttcctaaaaatagctctcatctgcatagtaatgggcctcctccatcccatttcttacatccttctagatatcccagaataatttaaacactgtcagcaattctctctctgaaagctctgttagcccatatactatagaaccagcctgggacactctagttcatggtaccctcatcctgtggcttagatctcccatagagtggcatggatgccctcttgctctggtaccttttggtcatcttctctctatgtctgcacctgtaccctatggccctggccacatctgcctctagatttagtcatctgtattcactattgtcaccatgaagtaggaaaacactttaagtgccattcttggcaaggcagaatagcggcgatgttgggttcttaatatttattttggttaattcatcttgaatgtgcacatgggtattctaaatccaagacagctttgttattaattagtttacagtaaataataaaattattggaccatttccccaaaacttaccttggaacaaagggatgaaagcagctggaaacatctccttcatgagtggccagacactccccagataagaaaaagagaacaacaaattttcttattttacatacttaagagagatggcctgctactcgtttcctaagaggagagagaagaacaaaaccaaaatatttgttccttagaaataggatggaggctgggcatggtggctcaggcccataatcccagcactttgggtggccgaggtgggaggatcgcttgagcccaggagtttcaggaccagtctgggtaatatagtgagacctcatatctacaaaaaaattaaaaaataagccgcgtgtggtgccacatgcctgtagtcctagatatctgggaggctgagatgagaggattgcttgagcccaggaggcagaggctgcagtaagccaagtttgtgccactgcattcctgtttgggtgacagaaggagaacttggaaaaaaaagagagagggagagaaagaaagaatgagagagaaaaaggaaaaaaagagaaagaaatggaatggaaggaatgctgggttctcaccctaacctttgggaatgttaatgtctttctagataaacccagatcctggcttttatcatctaaaggcatctcctaaattcgggattcatctcttttgctatgtaaatacctagaagatagtgctccagtcctcctgataccttgggacattacttagggacctagtctagctgtaaccatttggctctcaggaagacaggaaaagtgttatcttttcaaatcagaaatagaactacttctagtatatgaccagtaaaatgcttcaggggaagtcaaagcaaacattccctatctgcatatgagactcatctccttgccttaggaaactagggcttctcataggaataccgggaaaaccaggaaagtgttatttccactggagagtctgtgtccttttctcagaatggaattatttgaattgctagtgtgaaaggaaaatcttggaaccccaaaattgctaagttaaagggaaaattcaagctgggaactgctcagggcaaacctgtctcccattctattcagtcatccctctgctcactgagatagatgcagatctgattgcctcctttggaaaggcttatcagaaaatcaacgaatacaaccatgtctctcacctacttgtgatctgcaagtaccctccctgcttcgaattgtctcctcctttctggactgaaccaatgtacttcttatatatatattgattgatgtgtcatgcctccctaaaatgtataaaaccaagctgtgcctcgaccaccttgggcacgtgtcctcaggaccttctgaggctatgtcatgggtgtgcatcctcaaccttggcaaaataaactttctaaagtaattgagaccatctcagatatttggggttcacactagtaaagatgttttggtggtggtggtttgttttgtttctgtctttattttttttatttttttgagacggagtctcactcttgtcgcccaggctcgagtgcggtagtgcaatcctggctgactgcaacctccgcaattctcctgcctcagcctcccaagtagctggaattacaggcatgcaccaccacacccggctaatttttgtgtttttttagtagagatggggtttcatcatgctggccaggctggtctagaactcctgacctcaggtgattcgcccacctcggccttccaaagtgcagagattacaggcgtgagtcaccgtgcccggcctgtttctatcattttttaaaaggctttccatatccatagctttctcctcagaccagggtgggaagcggtggtagtgtcttgtgctcagtgcctcttcacttaaagtgacattttctgccctgtcaggatccttgttctctctggctataatgttcatcaatatcttctgcattctccttactgtctataaaccacaattatgggcaagattcaagttcttttctgtgaaattcttaggtttcaagaaaatcaggggttatgatgaaatatgatggagtgtcacctggttctgcatgttagtgtccatgagctgttgctcatgtgcatttatttaaaacctagagacgatgtataagataaatctagtttataataaaatagcgagattgaatagatcacaactgtgtcagctgtggtgaaagcactagaaattaagttatttttcttttctgaattgacagataatgacaataatcacacattattgtttgtattagattattctttcaaatatacttagtattccttgtgtcaaagatattgttttcttccaagtcattttgtataaagtaatatccccctacactctggcataataaagcaaccaactcatattgcaagttttttttcagacaaaaaaaaaaaacagttaagatatatgcaatgttgctattttattataaattatattcatcttattcatcatctttaggttttaaatagtagctgcacttgtagttaaatgctattttaattctccaatgaatatcttatatatagaaataaagaatataaaactctaaaagtgcttttcatgcagtttctcatttattacccctaataccccattatcagctgaactgtgtccccacccccccaaattcatacattgaagctctaaccctcagtgtgattgtatttggagtatggcctataaaaaggtagtaaaggttgagtcacaaaagtgagtctttttttttttttctgagacggagtcttactctgtcacccaggctggaatgcagtgatgtgatctcagctgactgcaacctccgcctcccaaattcaagcaattctcctgcctcagcctcccgagtagctgggattacaggcacatgccaccaggcccagctaatttccgtatttttagttgagacggggtttcaccatgttagccaggctggtctcgaactggctggtctcgaactcctgacctcgtgatccacctgcctcggcctcccaaagtgctgggattacaggcacgagccaccacgcccagcaagagtgagtcttaatccagtatgactagtgtcctcataaaacaaggaagggacctaagaggcctctctctccctgagtgcacatggagaaaaggccctctgaagattcagtgagaaggcagccctccacaaaccaggaagagaggcctcactagaaaccagtcctgaaggcatcctgatcttggacttctagaaatgtggcaaattaatttctgttgtttaagccactcagtctatggtagctcaattttacaaataagaaaagaggccaaggaaaggttcagaaacttgctcaaggtcacgaagcagccggcagattttcagcagactggatggctacaagatcagtcaaaataagttagaaaagatttgaaaagaagtgccataagcaagaatatttaatacacagagtagagtttataataacatagcaagattgcttacagcctaactggattgctggatgagaaattcaggcagagagaagcaatcttatagagaacatcacgtgactcagaaaaggcagaaataggcttttatctgttcttttgaggctggataacccttggggcaatttaggaagaactttctagaggttcacctagggaaagaaatgaaagagtagctagatgataaagtttgagatagtaagatatccgctaatagaaaataaggaaaaagactacttcccactgtgtttagaatacagttcaaattccttaacatggactatctttgtggtataatgctataatttattaaccaatccaggacattttttgaagtcaaagggagtgctattacaatttttccaggaaaatatggtaaaactaggacagctctgggcaaacatgtatatacagttaccttggcgataaatgaaggccctgcatcacctgaccacatcttgttcaattttccccattcactgatcctactgactttcttccagttctttgaacatacccaccgctaagctcattcttgctcagggacccaacacatactttcagtctatcttgttcagctcttctctctttgcctggttaactaataatctctgtagtgatcacactctgtaggccagttacacagcaacccttccctacttttttctcaattgtacctggattttgcccagctgtccctcacacaccctctgtcacttgagaaactctgtaactacaaccttagtccggggaagaatactcacaggaagaagtcggtcagccgtggcattcctctgtctgccaacaaccttagttttcagagatagggtcttgctctgttgctcaggttggtgtacagaggtgccatcatagctcaccgcagcctcaaactcatgggctcaagcgatcctcctgcttcagcctcggaaagcactgagattacaggtgtgatccactgtacccagccttgcctgggcaatgacttaaggaaaatatattagtttggagcttcacatggcagaaaactctcctaattagtggtttgaatgaaacagaaattcatttctgtccctcatttaaaagaagtgaggaaggagacagccgggggccgggatggtgttatagctgtcaagcactcagggtccatattgccttgttaccttcacatgtggctgtagatcttcagatcatattcacattgcagcagcaggaagcacgaagggacagggaagggtacaccccttccttgtgagaatatagcccagaaatcacttccacttacctctattgccaaaacagtcaaaagggcacacctggttcttaggaaagctgggaaatgtaatctttgttccaggtggctctgtgccccactgaaaacttaggatcatggatcttgatgcaaaactagcagtctttctgccacagtgcaccaattagcccgaagggaaggactcagtcctagcatactcctctttccctctcctgctggacatgaccaagaagacaagaaatccaagttgcaactctttaagtgagagaaaaataaacatctaattttttttgagacttcttataaccataaaaagactcaggcttaaaaggaaattgatactgtggacagcagagccaaaacaagaacccaggcacctgataatatggttgagccactgaaaccaccagctctccatgagttaccgagagaagaaacttctttattgcgcaggccactttggttcagagtttcttctccttgtagctgaaagcatgttaacgaaattccctacaggtgccctacacactccatctgttataatttaacttagtaacctcttcttttcctttatagccttcattataattttgaatcatttgttacttgcttgaagtttatgtcctctgctaggctgtgagccatgacctttgggtctagatttgttttgtaatttattgtatacctggtgaatgaaacaaaatggctggcacgatgcttggcacacagtaggtgtgtaagtaaatggtagctatgataaaaatgatgtttgactaataagccttgctcattcaaagagatcacttctccttaaaggtagcattgaagccacatgaagtaatgaatgacagtttggggagtcattttctcttttattctgcaggattttgtcatatactactcattatttcaactacatcaaagatctatcttatagttttggtgtgacctcaaatttgaatattggactactttgagctatagcttggtcttaaaaggaacgactgcagagctgagtgcccaggtgacagtcacagctgcagcatcagcggtcatgctgttactttcactcagacatcacaggagtggtgactacataaatgtgactagaatagttctcagtctcttctgtcacactacaatattgaagtgatgtcttcccaaacactggaggccttgccttctcatctgcagatggcaatcctattcacgtctagcttttaggcacacagttttcttcctgagggcatgtttcttgataagttttcctttttataccctcttcccaaagccccaaaacctgtcattttaataatttaaataatatgtttatatctacaggtaatctctaaagtcttttattccacgttgaggtgtgcttctaatgtcatttctgtctcatctactgtttgtttatatacctaggacattaattacagtaatgtgccacaaatgatgtttcagtcaaggacagactacatatatgtaatatataagactacatatataatactgtattcttactgtacctttcctatgttttgatatatagatacacaaatacttaccattgtgttatagtagcctacaatattgagtacagtcacatgctgtacaggtttgtaacctaggagcaataggccataccatataggctagatatgtgttaggctatgcatctgggtttctgcaagaaccctctatcatgtttacacaatgatggcattgcctgacaatgcagttgtcataacatatctttgttgctaaccaatgcatgactgtattatttatctcagttctccattctatctaaatgtgattaattactacataaggtgcttaggaaaaaaagtgtaaccatggcattgatcattggtaaaatatataagtcttcactttcaaaaactttgttcagatttttttttaacttttagcaatggtaatactaaataggtatcatttattgagtccctacactattccaggtattatgatagatcgtttatataatgtaagcagaaaaagtatgcatttaatcagtgggccaagggttatactacaagctgctctacgttatacagaatgaatagttggaatggttcaataataggaaattatctgaatttaaaacattttaaattatcatttgcagttagatgttactcactgaattatagagtaactaaaaattcatacacacacagatcgaaaatacatttttaaaatttgataaagttcacagaataattgggagggttaaaagcaactcatctttttatttatttgagtattttttagatttataaatatccctatttttaaaatttctgagatttaattcactcacctcacctaatcatggatactttgtcttaaaatggaaataaaaataggcatttaatctttgccctcccaccctggtatcttctccccctggtcctctgtttctcagcttctgatggttacgacccatgacttcctgacttctccctctaactaaagcttcaattttctagctgtttagtctatcctgactatcacaaggcagatatcaacagcatcaatgcccttgtgctctagagttcagcataattaattaacgatccttcactggaatctgggagcccagctatgacagctttgctccttgagtctcctcagtgagtagccatgtgtgctcataaagtgcaacttttctttcccattgccgtcatccccaccttatattgaattgagagtctgccatggtctctacttctaaattcagccagattattcaacttactaccctgggagtcttgccccgaatacgtactaataccctataccctctatggacacacattagccttcacttgcctaatgcctggatattgtctctactgtaagtttctcaacactggtttcttctcttatgatcagaaaactaagcccaatcagagcatgtaatatgtcaaggttatgtgcctagaaaatgcaactctggagaaaagatttactaagaattatttctctaagacttaatggaaatggtccagatgtatttccagatctccatcatctatgtgttttattctaacaactctctccctaaacctttaaataacttttatattatataacatacaaaaaaaagattcttgccttaaaaatattgattctaggcttggtagaaggactgtaagtaaactctaaggtgttaaacagagaagtgcgagtgtcatgtatgtacctctctgtattcacatttatatccaatggctcaatgaacactgaaaatggagaaatgtaattggtgggttgactaaaggttatttcttctttatccctgtttgagaaaataaggaagaaatgattgatttactgtttttttttttctgaggataatcatgtcaagaatcatttggaatcacctccaggaaaactgtcacaaaactgaccatcttttaaatatggtaacttacagtgaagcatgtctcacacaaatgaatgacataaatgcagaaagatatctgcagggttcacgcataacttacctcagatgctgattactgccaaaattacaactgccctgcaccactcttgggcactgaatcttgcctgtctatatgacaaaatcagtgtgcccaagatcattttcttagcatctatgaccagattgcatgccaggctatgagttcttttcttccctacccactcctagaatatcatataccttatgatagtcccacaatctgacacgtttcagtcactgaagcagaatttctgcttcaaaaatctcagttttagtagtatacccacatcacttgaatggtactttttactttcttccaatataagggttcccagagtgtaatatgagaaaaaaaaaaaaaccatattctccagcacccacaatctaaaatgaatgaattcttttaaaacattttttttttccagaatagacctttcaaaggaaaccatgaaagattcggacatttccttatacattttttaagttaccaagtggaataatagagttgcatatgaatttttaactctgtaggtattctcagtgataaaaacgtgtgcacggctcatctaaccttctctttcatacactgattttaaattcttttcagctttatatatataagtaaggagcatgaaagtggcaataggtccacagaaagaacggacctctaatagtggattttgcctgatttattccctttacatggaggtcagataagctgatgaagacattgagtgcctcaatggttaagaacaagaggtgaaagcatactcccttgcaattctgggtatatgtgtgcaagcagaacactgaaaatcaagactgagcagctattaaataactcgagatcaaaaacctagggaaatgggtccatgtgagttaacatgacgggtagagcctcagatggtaactgggaactagagggcagaagacaaggattctaagtgtcagggggaataaaactgaggtacagcacgtcaaaatgtgtgagcagtatggcatccagaacaaaagactgagatgactcataggacttaggataaaaagataataataatacccctcccattacagaaaaggatggggctaagtttcccttggctctgcagaaatccttacgacattctgaatatgaaaatgtatgaaatgggaggtagtccttgtgtttagggttcccaagaccaacccaccagcagggctcacaggatgaaatatatatataatcatattcacagttaggggtattacagttaaaggatataaaacaaaatcagcaaagggaaaaggtgcatgaggagaagtttggaagaaaccaggcacacacttccaagagtcctaatggagtctcacaggatgtgctcagttcctccagtaacagatttatgtgaagttatcagccaaaagagctcattaaccagtgctcaaggttttcattgaggggtggcaatgtaagcaccctctgcctaacacataccaaaattccagactcccagaaggaaggcaggtgtttagcataaaccacactgtttctacaaacagtttaggccattcttatcatttagggaaagttttatatcagtgtaggaaactgtttatcagccaagttatccaacaccagccaagagccaaccttgcaagcaggtcttttttaagaacagaagcctcaggtctgttaactcctttctacacagttcccacaataattttccctctttgtttccttttcagatatagctgcttttgtttgcaaatgggaatccagaaactttcctataatcaaaaaaactcaagttaaataattaactcaccatataggaccttatttattctagagctttagttgtcttaatgtatcataaatggggattagcctgacttcaagtagcaggtatttccctaaagccagcatttatattggtagtgatttcacaggtccattaacctcagctgggactagtttctttagaatgaaaatgcagtgatacaaattacaacctaggttctctggtgaccagatgttcacgatagcatattagagatatagtttcagcagtgagtttgtgggtgagtcagaaaaggccaagaagacagaaaaatttactaggttcgttaactacgagaatgctacaggcttcacaaggagccaagcaaactctctcactttcctgaaaaggatagttgtccagataatataagcagagaagctgaatattaactgctaaaactgttcaaagaatcccaataacttttggacgtccttgactgtctagagaatatggaagggcttcttgtccattttccttgggagggtgaggtacagattctcggaaaccaatgatctctggtatgctatctggttctgctcttaacgatgcacaataaatgattctgacatgtgcatgtgggccaggcagctatgaattcatgagctaactgctcaagcaagctcagggtcaagtgcctacaggtgggctagaaacatggttcaacagctaggttcaaatagcaagtctgagaaaggagggcctgagatgggaatgaagaattagagtgaaaagccaagacgcaaaagagtgacagtgatgggagaacaaaaggaagagaagctgcttggagaaatactatccttagaggtctgtggcggacaatgggctttttataagttctccatggtctactgagtgaataaaatagttctgtttgaagggatctgagctgagtaggcaaacttagtattaaaaaaaggaaaataaatgaaggaaatatactataataaaaatttaaatacattcttacattttcttatgtgctataggaatcattctcaaaaaagctttcaacagaaataaaatgacctgaaagcaatgtttttaaactaccgcaacaggcctgagatatcgatccttagaaaaacctgtatgcaaggttggccctcggctggtgtctgggaacatggctggtaaacagttccccgcactgataggaaactttccctaagtgataagagtggctcactgtgactaactgtccacgatgtggtttatgccaaacatcttcacataatgtcccacctttccttttgagagtctggaatttgggtacctgctagccaaaaactggttttccttctgaactttttttttttcctctttaaagagattcacaaacatagcactcctggaattatcacactggaatagtctacttaccagcttgactgattatatctttcgattaaccaagcaagtatcttcaaaacaacaactataacaaaaacctactgcaataacttctggcctggtctacaaactggcagtcgcatccgtctcaaagaaattacttatctactgagagcctacatggtcatgacactcaactgatctaaaatcctcaaaagttcgttattgtctcctgaattatgatcaaacttattagcctggcactcaagccttttacaatttgtccttggcctacatattcaatttagctttacactttaccattttacccatttacactttaactgttcgttacctgtgtgtgacatatatgctttacatgagaattctttcaaaaatatcatgatctatgatttcaaggtatctcaattcaataagaatttttttgaccatctactacgtgcaaggctcagtgtcctgggcactgaaagggatagaaaaatgaacaagacctgatccccactctctatgatgaacaacataattcatagtcactttctgaaaaccatttgagtccttaatgtgctagatctataacatgctccattgcaggaacttccctggggagcttggtgctttgtggactctttggatattcccaataacaccatatttaattagaacgtttttattggccgggcgcagtggctcatgcccataatcccggcactttgtgaggccttggcgggcggatcggctgaggtcgggagttcaagaccagcctggccaacatggtgaaaccctgtctccacaaaaaatacaaaaaaatagctgggcgtggtggcgggcgcctgtaatcccagctactcgggaggctgaggcaggagaatcacttgaacctgggaggtggaggttgcagtgagctgagatcgcgccattgcactccagcctgggcaacaagagcgaaattccatctcaaaaaaaaaaaagaaggcttttattatatctttcagtttatcccctttttaaaaagcattatctggccatgtgcacacagctttatttaaagatttccttataaagtgatttattgttcttacctcttcttagcttggtgttacagaagaataattatttgcaaatatgaagatcaaaactttacatttattctaggtttctttctatccttcagaaatacagttaggcatgtctttcccagctgatcgctatttactcaagcgctgacaaagcatgccaatcgctccccccattactgccactaggttctgagctgaaatcattaaagagtacaagacacttagtttaaaaatgctacgtattaatttaaggtctgtaatactatttcagataaacagcctcagtttccttcagtacaacctcagtgtttgactagtagtatttgcatcaaaaagcattaaaaataaaataacacgttacaatgttgaagactaccattcataatgaaaatgtaactattattaatacttgcttaccaaataatatatcaacaatttttgtgaaggagaaactataggagatgtgagaataaacagacaaaacacagtattggagattttaacaaatctctcagaatccaagaaaatgaaggtaacaaatattactacagatgtaaaagacataaataacataatcaataaggcagatctcataggtatctatcaaattctatatactattaagaggaaataccttctttcaagttgcacattgaattttcacaaaagtgacattttaggccacaaagaagacctcaataatccaaagaatagaaatatacaaacagcattctctgcctacatgatttaaaatcagacattaatttaaagcaatcaaaaggaaaaatggtactttctcttggaaattcatagtcagaaattttaggatacagctaaagcagttaccataacaataaacatgaaaaatataccaactaaatatccaatttccaaagctaataaacaaaaaaagtggaatgaaaaaagttgatagtgttaaaaccaaaaattaatgagttggaaaacagtagagttaattagtaaatgcagaagtgctttgaaagaaaacaagaaaaaatactaattaaaacaataaatgaaaaaggtagaaagcacaagtatacataattagaattaacaattaataatttaaaaaaaatagaagaatagactcccttgggaatttctaccaaattttctatcaaatttttaaagaccagatccaaatgctacttaaaatatcccagtgcacagaaaactaaggaaaacttattttccttgttatattagaaatatatattttctaatttgagtataatattacaatcaaaaaaacacatcagtttcactatgaatattgattacacaaactaaaaaacaaaaaaccccaaaattagcaaagaaagcacaagagcatattaaaaactaattcatcatgaccaggtggagtttattccaggaatgcttactgggccaatattataaaatctattcatataacccattaaataagcagaggaaataagatagaggaaagaagtagaggaaataagatagggaaaatgcatctgaaaacaatttagcacttgtttatatttttaaaaatttcccaataggaatagatatttcctatcaatatgcaatatatattatataatgatacatgtacacacacacacacaatttccatctcaaagccaacatcttacttgatggagaaatgaaaggaaatttcctgctcaaatcaggaacaaaaagatatcagttgtccccatctgactgaatatcatgttggaaatattagctactgaaatgaataaacaattggaaatataataattggaacggaaaaggcaaaatgatatctaatgtaggtgatataaatgtctagaaaatctaaagaaacacttggaaaaataaaacagaataagaaaattccctatcccatccctctcctgctctttttgtggacttttatgtgtttttagcactaccagtaagtcaagttaaaaactgtggtgtcataataataatactagtttcatttgagtgttcacaatctgcattcactctatgctttgcagacccccactcttatttaggcagttgctaagtaacatagagtttgtttccgaaatgcccctcctatcagtcttccttttgggtccatcactcactctccacatataactggtaaatggttgcctgtgtagcgatgcttgttttacatgtaatttccctgatataaagtcaacttcttgacctggttttctaccataacttacctttccaggcttatttctgcttactcttttatacatgcattgtttatcaggaccagccttctgagtatctcttagatatacctgtacttgcagttcaacaacaagaattatttccctaaaacatgctataataataatgtgtcttgtttaggctttgtgttaaataatttgcacactgtgttgtcccacattaccagggctgtaattccttcctcctttgctatgtaacttcccagggtatttttttgttttacatttcagatttgtttttattttattaactctacctgattatatacttttgagtgtagaaagtgatcagtacaatctctgtatcacttgcagtatagatggcattcaataaaaatccttttttttctttttttgttaacaaactgtgccagcctggaagttaaaaactaagattttaaacgcaactaaggatctctctttagtctctattttatcgatttttcattagttggctctatttgagcagggagtctgccttattagtgctgtattctcaaggcttagaactattcctggtacacggtaggcacttggtaataatcctacctgtatggctatacaaaaattaattgaatggtcatgaataatgcaaagaagcaaaagcttaacaagagacaacataagccagtatcaagatcagatgttcacagttttctggtttgttcctgatcacattccaggacagatatttttgtttggtttatggactgaaatttttaaaaaaaatttatttcagcagaccctgaatccatttttataaaaacccttagctgtgaaaggaacaaaggttttggcagatagtataatcagagtcaggattggctcggtttgaaccctaatgcccttcaggatattgaaaatgtgataaaataattgcattatttattaatgacccaacgaaattcttatacattatgctgtagagcaattccgcagccattatcttctttgctcctaagaacccagaaaggttatccttttatttatcagaaatcaccatgttaaaatgcaaatacttaggatcggtagcctcaacccttatcttctaaaacatctttagctatccatacaaagcaaagcattaataggaattggactgacgttggaggtggaaatactgatgcacgtgacagctttaaggacttgggcggctaattccccactccccactgctcctcagatcctccaaaaaaagctcaagtcctaactttgaccaggtttgacaaagaagggagaggaccaggcgttttgtaaagtgctgcttccaaacgccacccgtcaggacagattctaaaccaccttaacttgctgccggtttcaagtgaaaataaatggtacataagtaatcaagaagtcgcagtcccagacctctgaccaaagaaccgaaaaaggacagcgaacgaccggttcccaattctctgaacccaaaggtcggagaagcaatttagaagaggagggggtgggtcttccacaacaaaccccgcccctccctcactcgtcgctgattggtggcggcgttaggccgcgacggaggggcgggcccgcggctgagtctctccctttccgcgccgccccgtgcgcgctgtgggtgtgtttcgggaagcgggcgcgcgcgcgctcgcgtcggaggaccggaaaggaggcggggctgcggcggcgcgcgctcccggaacgcgcgcaccgcagacggcgcggatcgcagggagccggtccgccgccggaacgggagcctgggtgtgcgtgtggagtccggactcgtgggagacgatcgcgatgaacacggtgctgtcgcgggcgaactcactgttcgccttctcgctgagcgtgatggcggcgctcaccttcggctgcttcatcaccaccgccttcaaagacaggagcgtcccggtgcggctgcacgtctcgcggatcatgctgtgagtgaggccgggccggcggtgcaggacgccgggaccgggctggggcggaagccgaagccgggccgccgcgccggggctgccgtgccggggccgcgggcagggcgtccggatcgccctcctgagcggcagttcgcccccgagggcggtcgtcaggggtggacgtcgcaggcttttccggcgtcccctcggaacttgcacccctccaccgtaaattcccgggcttgctcttaaattttaattttgagcgttcctcaggtcggtgcctccgcttgcttcctgttcctcacttccctccacccacgcctggccaatgagggagcaacacaacagcagagccggcgccgccgcccgcctgggctggcgcctcccgcgcgtccggtgccgctcgtggtccgcatgcgaggccctccaggcgctgccgccgcgctctgggtcgggcttccgtggggtttcctggcggctctggaggccacaggacggggttgtctttgtgtcattcatcacccgagtttgccctgtttgacattccctttacagttgttgcctttgcaccttcagaaggcagtaaacagttggagctgctttgaagttggccagagatgttgggcactgagagaattaagcatcttagccttctgatacagcgagatttttgttttgttgggtttctttatttctttttcttttgccaaccacttgaagaagtctgcgaaaacgccaaaaaatgcagttcgaaatgacagtgccatttcgctattgcctattttgtccttgattttattctctggcacttttgtctttaatcgtcgtatttttccatctcttgttctcatacccttctactctatttccgtcttacacaagttctttaaccttagtttatttctttgtcagaatcgccaagaagccagttatcaaatagcgagccttctccccccaccttttttttttttttttaaattactgtactgatgtttgttagatattgttcgaatagacctggggtggacatcagcactgccattgtcagccctgtgagggttagaagagcttggtgcatattaaacactgaacagatgttagctgttgttgtcttgagcaagttttcttaccattctgggccttaatttctttttgtttaagatggaagtaatacctaatttttaggttgtgagaattatttgaaatgtgaaaaatattgtcagtgggtctgagccgtagtaaacagtaaatagcagctggttacagtagtatccccttaatggggtaggtatacgttccaagacccccagtggatggctgaaaccacggatagcaccaaaccctatatatacttggttttttcctataccgtacatacatacctacctatgataaaacttacaagttaagcacaataagagattaacaataacataatagaactgtaacaatatactataataaaagttatgtgaatatgatctctttccccttctctcaaaataacttattttactggactcacctattttcacaccagattgaccgcggataattgaaaccggaaagtgaaacctcggataagggggtgattactgtatcaccctttaatatgccatctgttagtattcgtatcaccttgtagtcatgtgtagctttcttctacccattctgcaaaattgctttacatcaagtatttactattctttttagcagtttttatccccttctgagttttgttagggattctcttgaggtatatgcaattagctgaagacctactttaatattggattagaatgtttctcctgttttcacacttacaggtttctctggtgtttactcgtttctttgtggaattgcagtttcacctatgcacacacctgtattctttctctttaagaagttacgtgaattgtgtatgttctgttggaaggatggtaaaacttttatctttattcctagaaaaaatgtagaagatttcactggacctagagaaagaagtgatctgggatttatcacatttgatataactgctgatatcctttaagaaaatatttcgttgcgttttctgtagttttataatgagatatgtgttgtttaatgatttgggatacagtgtgactatctcattgaatcagccaaaccttggaaattccgcctttttcatcagtaaaataatgttaatacctccccatgacacttggagaaaacttcatagattcatgagtagttgtgtgaacatactttaaattcttaaccgaaacattaaattgattgaaaactacataagaaagtttgaatctgtattttagaaagaaaaaataaaattagatcatttggataagaaggaaaaatattaccaatgctcagcctgcctgtgaatatttcatgtacaatttcaaataatatatccatattttattatagcagagagaaacatatgtttaaaaagtgaattacgtgtgttatgatttgaaaaggtcatatcaaaattattggtaacctgtggttgctttttgccgtcataactctttttataaggacttttataaaagtcagaaaatattaacaattataagagtttctttggtggtgatatttaaatattttctcttgagattgagtttctatcttttgacaactctgatcattttggccaggctagtcttttttagggtctttcttaggttaatatcttggcaatgttctctgccatttctagcctgatttcatctgcctttttaataccccgtgatttaaatggttgtggagattgaacgatctgaacttgtgtgaaagtacctgtctgaacagttaaagctgatcatatacttggggaatttatctaatttgcctttctatgaccatgaaatttacttttagcttaagttttggtaattattggatttagaaataggctaagaattagttctgtaggtacctttttaggaaatagagtgtaccatcggaagagtcttatgctgaatttcatgtgtatttttaagtctttgtgtaatttttaaaaatctgcttaagggaatttaggtctactgtgagggtagtaattttgtgtatccagagaattatagtgaaatttcctggtatctatggtatttatatattaccaatctcattatttgtagtttcttcagattttcttaatgctgctgctactactacttgaaattgttgctgttcttgtaaacagcagtcctagacttagttctaaaggagtgattcttagtggttacacataattaataatggaatgtaacaaatgtgttactaccagtgtggaaactcatatagtaaaatgagttaacttaacaattaacataatacttaaaaatccaaatattaactccgcttatttcttggtattggcaccagtcttgttaattctggtgaagttcttgtcctctttgggagactgaattgagccacattggtgtcatttgcatctttgagagacattttaatgtctacttgcatgtgaccaaaagtgacatgtacaatttattatacttggttaattattgagccttgtttatgtttgcatattgttaaatttaaatggtggtgattgtttatactttagagctccagtggaattgtatttgcttgaaatatcgagtcctcttttttttttttttaacttagttgatgttacagaaaaccaaattttggatttgttcttttcttactagtcaaagtatctcagctagtaatccttggaggagtatgggaggatgccagtaatctcatactgacatttttttgttttggaataagctggatttcacaatgtatttatcttctgcatatttttattaaattagtggcacattatgtttctgggccgcctcttttctactttagtattactgttatggataaataacctaagaataattaagatctatttaaaagtgatatactgctcataaatttatattttccttaatttacttacatctagagaatatatttgattggaatgttaagcagttgtttctttatttatcagcagaatattcaacaaaaaataatgtaagtatatctaattagaagtattttaatagctatttaaagtcttactctttacgaaagaatacacatttttatatatttaaaatatctgacctgagttacctagcaaaacatcacaagccagtggaggtagctgtgttatgaaaacatttgatcttttgggagcctttttgttgttgttgttgtttgtttgtttgttttctgtttgttctatttagctctctagcattggggtctccagaatggagacttgctatatgaacagacgttaatgttcatattcagcccttaagtcagatagatgggcacatgccttctacaatatgcagatattctggaggaaaggaggaattctgtaggtcaagaagttcaccatgctacctagtatttattcatttgctttcagcatgttgtaaaatattgcagtatatgcaatacataagtggattatattataaaattttagccaatcctttcaaaatggaaaagtggcttaaaaagatttctgcaaagaaatcacagattgaagataatgctaataatccatgcatatgtaaacagtaggaaaatggtggagctcatacttgtattcctcttctgagctgctgtgtcacactgaaggattaaaaaaacacaaagacaacctagatagatctgataacttggctgagacactgtcaatgatattaattaacaatagtaagatcagaaagatattgctgaactatcaactaggaaatggagtgggtagccggtagtattgccaccactcagctgtttcctttttttttttacttttttttttttttttaagacagagtctcgtgcttgtagcccgggctggagtacagtagcgccgtcaatctcagctcactgcaagctttgcctcctagattcaagcagttctcctgcctcagcctcctgagtagctgggattacaggcgcctgccaccattcccagctaatttttgtatttttagtagagacggtttcaccatgttggctaggctggtctcgaactcctaacctcaggtcatccgcatgcctcgtcctcccaaagtgctaggattacaggcataagccaccgcgcccggccgttgtttactctttaagctaaaatattctctctccacagctgcaattagagagctgcatggtgacctacttgaatcaacaaaatttgagacctgtgattataattctcattatgactatatataatcaaaagctgtaaagattgttaataattttcaaaccttctgagattattttaaaatccatcttagtaccagatacctttctttaaaaaaaaaaaaaaaaagaacatggtgcaaggtgtttttggtagtctacattaagccatatagctacaattaattaatatccttacctattgagaacaatttgcctttgttttagggttgcatgggattcattaatctgagtatctgagtacttgaactggttttttgttgttgttgttgtttttatttatttatttttaacacggagttttactcttgttgtccaggctggagtacagtagtatgatctcggctcactgcaacctccacatcctgggttcaagtgattcccctgcctcagccccccaagtagctgggattacaggcacccaccaccatgctaataactttcaatcataaactaatagttttaataggttttgatataatggtttaatagcttttaattataaaacttattatgaattataatttgtgatttaaaaaactagttcaggccgggcacagtggctcacacctgtaatcccagcactttgggaggctgaggcaggtggaccacctgaggtcaggagttccagaccagcctggccaacatggtgaaaccccatctctgctaaaaatacaaaaaattagccaggcgtagtggtgcgcgcctgtaatcctagctacttgggaggctgaggcaggagaatcgcatgaacctgggaggtggaggttgcagtgagctgagattgtgccattgtactccaccctggttgacagagcaagactctatctccaaaaaaaaaaggaagaaataactgctctacatttctttttagttaatgtagtcatcatatactgagtaattggccttaaaagcgaatagatgctaacttaataagagcaaattccttgggatttagtagtggccacaaattttttttatttccatttcatacttttaattttctaaatggaacttatttgtaatatgttgaaagagtagcttaaaagaattgtctgacctctagaattttgccttgatgagacaacaatgcatgtattttcttaattaaagggaaaaaagatctttaaaaggcttcatttctttagtgatttcttaaagcttttgtaaagaaatcttggagaagatttcttataaattttcatgacataattaatcagcagtaacctgtattagcagtgtgatggaacagggattggctcttgtctgttttcctggcaccatttaggatccatgctgagctggagggtcttagaaattttatagggaaaagtgatttaaaagaatacttcccttctagggatttaattcatctgttcctccaaaggcctcactttttggagatcttatagatcaaaaaccttgcattaagttatgaaggcactaagtaatacagttgagttagcagaaggaatgaactccttcagggaattgtcattcttctctctgagaaaagtttgccccttttttgtatctctctctttgctatcatttgtatgcattaagatttcagcaagctcctcaagttgaattcattaacatgtcaaactatttgcttactaatacttttaatttgaagtgataagatggtatttctgatgagttatctaattaattttcattttaatataggctctgaaccaagttgtcctatgggacaagattgttttgagaggtgataatccgaagctgctgctgaaagatatgaaaacaaaatattttttctttgacgatggaaatggtctcaagtgagcaattcttggtcatttttttacatttaataagaggtgaaaaagagagaaagatgtatttttattttaaagaaaaatacttgagagtaaaaggagaaaaattgggaaagaagtatttatgcatatctgaactgaaagattgggtggaaatgcaaagtgagatctaagataagcaattctcttgcagtttctgaaatgtcatagtcaaactaataaagcttctatcctaagcgtgtacaaggaatacgggcttgttcagatgcggtagggctgtggtggtcaaatcaaagggctcctttctgagcgtgagtcgggaaaccttagaagcagcatgttgggtctaggagttgataatagttaaaagaagtagtattggttctccaaacgtgacttctctaaagctcattttagtcagtgtgattgatctctcaggttatttttacctcttagactctagtggtaaacattggaaataattttagaagaaagctatttcgaccaagccaaacgtctgtatttgcaatgaaaatttcagaacatgagaattttgttaaggtttgtccatctagataattgacagagttaggcttcaaatcattgctctgattcttagctcgtctctttttacatttactgttttaatcatttaaacttttcggttgatggttctaactgcagctgtgagtttagatgggtcatcctgggatatcagtaaatgtagtgcccctgtcttctagcattgtccttggattttaagtgacatgagaaaatagttctttttgcagattaacatattaggatttctgttaggaatagatggttataaataaagtatttgacatctcagtgtttgtcttaaaattttttttgaactactagtgtctctgatgacttgtgtttattatatctttttataggggaaacaggaatgtcactttgaccctgtcttggaacgtcgtaccaaatgctggaattctacctcttgtgacaggatcaggacacgtatctgtcccatttccagatacatatgaaataacgaagagttattaaattattctgaatttgaaacaacatatttttatacttaatgaattgtatctcattaatctcttcccttacatcttcatgtattgttggtttgttttttggttttgggtttttttttttttttttttggtataagaactaacatcaaaaggcctgtttaaagggaaaggttaatgggctacttaatattatgaacaaaacaaaaaaacaaggctgccacagtggaatattatcttacaagaataagaactacataaaacagatttgtaaaaaatacatatttgaagtattccctgtatttccattattctttatggaatataaagtaagcatgaaaggtagttaaaactttcaggtgcctgtagagtcataataactgtattttatgccttgcattcacgcaaattcacattggatgtgatttaaaagtagacattctctttttcctcttttaggatatgtttgattactggaaaattaatatggttatttgttagaagtctggtttataaaaaagccaaaagtgatggaatttattccatttgtcttaggaaggcccataatacttgtttttcttacatgtgactagcaactttctccacttaaagactaaatacctctttatatgatgtaaattattctaattcattttaaaatcttttaggtcagcaaaatgtgtgtcttcagtgctttctctaaaaacgttcctttatagctttgtacttttttttttagcgttgccattgaaagttaaaatgtttgcatggtttaccctctgagttatgtttcttctagtgagcatgcctgctgtcactaagtgaattatttactactttttgtaggtctatattttaataattattgggataataataattgtggtatgctttccatttacaaaccactcatatactttagtgtatgtcatcctcaataatctaatgaggtaagtagtataagtgttagctctttgcagataagaaactgaaacccagaagtttattgaattgcttcattgttacctagccagcaaggagtggaattaaaacttgaactcagatcttctaattttctgagctcatcctttctcttatacctcagattgcagactaatcaaattttacttaaaaccttcctgatatttttgttaccctggacaccctttctattctagaaaaggtttcccattttatatggaagtgactaattttcaagctgccaacaacttatatcgaggtaatattttattctctgaataaattcatttcacttatattaaaagcataaggaaatctacatgtatgtaaaaataacttagaaattcagtacataatacatgattgaatacatgatcgtatttaacatgttttttttttctgcagtggacaaataaacatcctcaaagtagcaactgcaaatcagttacccttagaaaagcaagaccaaacactgtagttacactattagcagtgaccaaaaagggctaatattttctaagaatagtttaaattacagacatttgttatatttaccttatgtgaaatacatcactatttaattacattaattttaacatctgttgtgtggagttgtatagttcatgcaaaagcctgtgggtatgggtttttcaaaccagcagaaaggtcaaaggtacctgaatgctaaactgcctggctcccagctttttcattaaacttttcagggtcttggtttctttatctgtaaaatgacagagttggaccagttaactttaatggccatccttttacaccacacaagttgataaaatttatctgttcagcaaagagattgaacaaaaaagcacgttagtaatatgaagacaggaaaacgaatgaaagtctaacacataactcatattgatttactttatttctgttagattttacactctgaaaatttcacctcatttagtttgtacaaatactagacatggaaacttaaaatgtgcaggtgtcaaagcttaaaaatcaggtgtgtcctctttaaaggcatgtgcgataagcctgcagtcttaaccagacctggtaccagtttaacagttcatgatacttctgtgatgagtggatctgttagtctggtagagattaatgttgaaatttacttgaattacagttatttgacaagcccactttttttggagtttggtgaggaagataagtaaaaatgcccaactagtacaatgtggagaaagttttctgtttgcttgactaagggaaattgctcagaaaaagaatgctccaacatgggaataaggaccttcagtctcaggaactcatttttgggtgcagtttctacatttaaaaaattgacttgtgttcagtttgataaccagttcatttgctttagtctcagtgttttaaagaagtctcataatgttctacaaagacacaaagcttcaggcttatacaaaactgagtatgattagaaatacctgagcccagaaatgattctgagaaaagagaataatttgaagacacttatttaaaagtaattatggttagaaatgaattaatttaaaaatgtgttcacatatccctttctctaacagtttaacctagacaaacatctgtatcagtatttttttattcccctgattgattacatttggtttctttattctgaaaggaaaataacaaaaacttcagaaattcctaagggtgtaataagaaagtgggttttgagtttcctttcctggaattattttacagttctttggtgggtctcgtcagccaattcatagctgggctttaagattatcatcttagagatgatagatgggctttttaaagatttcatcttagagatgaaaagctgggctttttctctaagatgataatcttaaagcccagctattaattgataatgaacatttttcactatttttttttctatctgaagcttagagatctagagctttggatctttcgggtatatgtcaatggaggtattattttataatactttgcattgacatgaagtgggttcatgggggaaaaccatgagctgtgaacattggtagcaaacaagcatatattcatttcaaaactttccttgcttttagcagagagaagcctgtatatgttacatgtgtgactttcagtagtttaaagagatgtttcaaaaaattgttgcatgtttttgatgcaatttgggaaattgtttacttcacaatgtagtcattcataaaaaaattcatgaaaatactgaacatatgtttgaggatttttcttttcctttttaaatttttttattttttctgagacggagatctgctcttacgcccaggctagagtgaagtggcgcgatcttggcttactgcaacctccaccccccaggttcaagcgattctcctgcctcagcctccggagtagctgggattacaggcgcccgccaccacgtccggctaatttttgtattttcagtagagacggggttttgctatgttggccaggctggtctcaaactcctgacctcaagtgatccacctgcctcggcctcccaaagtgttaggataacaggtgtgagccaccgtgcccggctgaagatttttcttaattgcaataaatattcagcattttttctaatgaaaatgaattttgtttaccagtaaaagtatgcattttaaaagactttcagatttatgctttttacgtgaagctgctaaactaaaagtaaatggaagaaaccaagtctagtaggttttttctttttttttgtgggggtgggatgggggaggttagttacacttaaaatatcttctccagagactgtatgctcctatactagactgtaagctctttgagggcagtctgtcagatttatctttgtatcttccccagcgcctagtgtagtgccttgcacataataggcgcccaataaatattgatgaagaatgaaggcgttgtgtttctaatgtgaccaaaccatggggattctttgtcattaataccgtcctcctttgtaagtgctgttttttttttttcattcttgagctcctaatgacattagatcttatcaggggcagttggacagttcagtaaaggtaaatgctgctcttgctctagttgctgtgacctatgttctttctgacttgctaagagagccaagtgatagtggctagtgataagattgatacataaattgctttactttgaaataacactggaaaaccctaccgtagacctgatcaagaaaaaaaaaaaaactcaggatgcatgtttaaagtatagctcaggaagaaatgggttaaaacaaatagctgactctttgaaaggccagggtgttggctgatcctccaccagcttcttgggcacattggctggtctggctcactaagggaacgtttatttactagtgaattcagacaatcaaaacagaaataccccctcaaaacaacagaaaatcattgcatttagagggtaagggattttaacctaagtgtatgttaccaggaatgataaaagaggtcagctacattttattttgttttctctcaacctgggcaagtgtataccagaactttctcttttaaacgtttttcctcatactctcttgtccttttccctctctcccagtgaagtgttaagaattcggagttcagtaaattgttgcctgattaatgagttgccatgaccaaaagaaaacttaccactttaataagtatacctttatatccaaataaacctcaagcttgaaggagctttgaagtgttcccttttcatgtgcataatttatacacattccacttgtgtatctgttgagtatagttggaaataggcacctaagagttgagaagtaaagggactgattagtactatactggagacaaagcctctgtgcatttcttctaaaaagtaccatgtttgtgctcctaagccctatgcttgctcgtgagtggcttggaatggctgcaagctccctagtgagtgagtacaaagggtgggaaggaatctaacagatgtgagtggggaggaagtgggttctgacatgcgctgaggaatctgaaacaaattcatcttataagtctgctcaaggttgtgtgggtctcgctcaaatttatttgagaaatccatggcttatccaactgtgcagcctctgctgctgctttaagaatctctaaatgctgttaattctctgcacgtgcaccgacaacccaggatgactaaaagtctaactgggaatcacacttaattgagattaagagagagattgattgctacctgactcttgccctcatctcaacatttgaaagtctgattaaacattctgttagttaaaataacaccaagtgctatgataggtgacatcaaacttttggtagcataagaaaaagtttgggcacggtggctcacgcctataatcccagcactttgggaggctgagggggatagatcacgacatcaggagttcaagactagcctagccaacatggtgaaaccccatctctactaaaaatacaaagattagctgggcatggtggcatgtgcctgtaatcccagctactggggaggctgaggcaggagaactgcttgaacctggacctgggaggcggaagttgcagtgaaccaagagctccactgcactccagcctgggctacagagtgagactccatctcaaaagaaaacaaaagtttatttctcgtttttacaaggaaccaatgtgggtattgaggcagctttccacatggtgtgactgaaggacccaggtgtcttccagcttgtgactgccgccccagggttgacaagacctcacttgaagttggcagtctggggttgaggaaaagagtggagaaggcccacctgcttaattagcttcgcccagagtatcacaccaccaactcgcattccaagggtgaaaacgaattgcacgtccctgtgcagataagcaaggggcatctgggaagtacaatctttagttgggtaatcacttctcaggaacaactatgtggtggatgggaagcataaatctttctcacatagtcattctatcactttctgcttatgctcaccagcttaagctgaccagcccctgttgtatcccagcagggaataccagtttattatagtcaacatttatttatctttttgtgtcttgtctgtagtgcattaaggattttctgaaggtgagcatattagatgttaagggttagattttaaagcacttatcaggcatgagttacctgatctaatctctagcctaatcatccagtacttaatttttttttcctggaacattatttccttactttgcagcagcatttatagctcttgctgcccttgggaatatatatatacacacacacacacacacacacacacacacacacatatatacatatatatatgtttcatgtttgtcagtttcatgagcaagaaggctatgtttatcttgttcattttactataagacactacatatttactgagtaaattgaattaaaagcaaaaaatgtgtgattaattttagttatattggcttacacaggtgttttgtctcatgtaaggtaggcatttcaggacattccatgacagattttcagaggataaatgaactgggtttttactgtaaaatgtaatctatctcctagtagtatctcagtgataaatgtttaacattaatggtaaagggaggtatatggagtaacttatatttgaaaagtattaggctaaggacattcataagtccttgtgaattaatgtctttcacctttttttttacatttgtaatggaaaaaaggaaatgtggaaaagtttatgagatatttgtatatagtttactgaataatataaagcatgtgcctttgtaactactactcagatcagcagttggaacaatactattactccatgcctccctccctatacttcttctggatcacaacctgttacctttctgcggtcttcagttttgtgttagccattttcttgccttgcttgaaaagtttactacctctgttgcatcctatcagctttactgccatcatggacaataggaacatctcagtggcttacaaaaacaaatgtgtatttcttgcatcaataggggcttaggatatactcctcacatctcttcattccagattccacattgagagaaaagttccttttgggattccaaagggcagttagaactgttggaaactcttggagcctctgattgaaggtgatgagcatcagtctactcctttaattgactcaagtatgtcacatggcaaagccaaggagttgaagggttggggagctagattccatagggaaagagcacaagtcacatggcactgagtaatactcttacaggaaaggaggagggaattcttagaaatgtaatataagctatcacacattcctaagcgatacagtttggtttggtttggttatgaacataaatgtaatcttaccataagaatttttggtcttgctgctttggcttagcattaactttaagagaatcatttatgtttttgtgtgaaggtgtagttcattttcattgttaggcagtaattcattgtaatatagtcatccatagtaggcatccggagtaggcataatttatttacctgttctgttgacagacatgtgctctgaatgttcttgtacaggtagcctggtgtatgtgtttctctaggaaagggatcttcacattttgttgcttgtgtagcacatcaaagattttttttaaactttcttaaatactgaaaaattttcatcttgtcatagaatgtaatttttggcacattgcaagtattaacattttaaagtaccaactgcacattacttttttttgcattactttaaaaatgtatctaaatgtatccagtggaatatggtatttatatgatttgatagaatcattcattttctaatgaacaaattcttccttagtggtcaaagttcttatcatttctttttcaaattatatttacatgcctctagcaaaattttgtcctaatgggtaatactctagagagtgctattttcaagtcttttattaataactgtaccacatttctttgtaacaaaaatgtgcatgtaaattgaaatttatcttttacaatttcctctgaccccaatattctaagttctaagggtgtaaaagttattctggagtaagttaattctgcagttatcaatagtacacagttgatcaaaacaagaagtatattagaaatgtgatagataatcgtaactcttgatgagatggaattagatatgggaggggataatttatgttgctttcattaagggaattattaaattatttctttgtccccaaggtttgatgccttgtggcagtgcaccatagcaagattctggatgaggtgaggctttctttgtgaaagggatgatggagggaaagaacctcaagcctgggcgcattaccagccagatcactttagaagtacgtgtgagagcagagctgatttccatacagctgtctgtcaccatgcacaaagttccatgttcctcctaatcgaagaccactgctctagcatacacacctaagattggaaattcctaagtcttatggaattcatatcaacatctttactatatattaccaaactttcccaaagtggtttttccaagtgtgagttctctttgcctaaatttgggtttgcagactttagtttttgccaagctggtgaataaccaatggtatcttattttggttgtaaattatatttctctgtttgctaaaatgagaaacttctattcatgtttattgttcatttggatttcttttgtaaggtgcctgttcaaattttgcccattttctatttgtcttattgatttgtaggatttctttgtatactctcagtttgagtcttctagcttaccccttcactttttcatggttccttttgatcaatcaagcttcttaatataatcaaatgtatcaggcttttctttcattcaataatgctcttttaacctttctcccagcttcttcagtgttatgaaatagaaagtgtcttagttttgaagtcagcaatatctgggtttggattctggtatagccactttctagcaatgtgaaattggctaagcaatgctcactagagtaagttgtctaagccttatgtttgatattcattgtttgtgcctggcattattatgtgtgctttgcatatattaaactgaatgctaacaacaaccctacgaggtaggtactattatcattcccattttaaagaaaaagaagctgagatcaagataggtgagtaacttgctccaggtcagtatggtaggtagtggtaaagccaatattcaaagcctggcacctgcactagagcctgaactctcctccatacagactgtgcttcttcctcagaaacatgggaatgagaatacctttcttttagaattgctgtgagcaaaaaaatatgtatgggaaaggacttcccagcatttttagtacatagcaggtttttgttatttctgtgaaatgtagcagagttgaggaaacagaaccgaacggaacacaaacattaaagtctctttgcaaagtcatatgtattttttttttttacagataattgtagagcaaattgaataattcttttaccttgttcagaacaatgagtctttcttcagtatctttggtgtaggagacagatgttctctgaacaacagacttagtatttttctggtaagaatagaaaaaaatcaatttcttagctcaatcatatagattaatttcttaatgatcttgaagcgtataggaaaatataccctcattttaaccatgtggcctaaaaagggccagagaaaacaaataataaagctttgaatggaagttggcgtgaaagacaaaatgcaccaggcaataaagataattttgctttagatattataatagggagaattttcatttctgcagcagaatgtgtcaaagaaatgaaggaggcttggggttttatagaggcaggtaaacaagggagtcaaggggaaggatggggggggtcagttcttggatatgccaagggaggtggttccttgaagttaactgtttctcacaacataaaaggtttttttttaaaaccattgctttttcctgggagcacagggctctggaaattttcaacaatgtcactgcctttaggaaagctaagaaaaatacggaatcctctactgtgacagcaaggatatgggtcagtatccaggcagtgacaatggtcaaagcaaatgtgtaacaaacctaatcaggagcctaatcccctaaagagatgaggaacccaaaatccaaaatgatttataactttaacttaaagacggatagttcactggccaccgaccagctctttgcacttgattgtaaatcaagaaattcaattaaatatttgctcagcatcttttttttttctagcaagttctttattttaattttaacttgaaatcagtgcattatattaataactccattggtcgtttgtctacttaacaatctttgatgatctttcccatagtgaaatgatcctataaaaccattgacaggttctaagatttttcctttgtctacccatccctactaactagaaatacatttctgggaagtagtctaacaataatttcagttttgaaaagggtcatggatggtaaggagactatattgtttaaaggcctttattgatccttttatagatttactggaagttgaaaactagcacaaagaggtcccctgtactccttcacctagttctccctcatggtgacatcttactaactatagttcagtatcaaaacatagaaattgatgttggtacagttaatagactattcagatttcatccattttacattgttcatttgtgtgtgttagtatctttaatgcgccagacattgcttatactctggaatggaatgtggtgatacagacagttcttcaaaacactttacactttcttgggaggtgtttggttttgttttgttttgtaatgtggcctcaattctcaaacctgcctttaagatttctccacttgtcttagagagtcaagaattaaagtattccaactgcagtgaatattaattaaagaataaatatattaaagtgggttggaggcaggggaataacatgtcacttgtcacattgagccagctagttagaattctcctgacggatgcaaaggcctaggaagcttaagttcctagatagctgagaatctttgccatgagtgaaaacaataaggaacatcactacctggttggaattgccaaatttggccaggcggatcagtcctttcaaatctaagtctctgtgttggtcattttccttccagcaaggaagatccattatttaacaggtatacaatctccaggaaaacctatgaaaggtctgtcagtatcttctgtgcttttataacacattcataacacacacacaaaattacagttaaagtttcacaaaatacatacacttatggggatatgcttatttattctttcattcatttttttaaaaattggtggttattacctggtaaatcaatttcaggaccgttgtttaaaagaaaagtcagttcaaacagtagtaagaattgttaggttggtgcaaaagtaattgctgtttttgccattaaaagtaatgataataacagcctaaaagttttcataataagagctacaatttactggctacctattatgtggtaggtgattttccaagaaaatgaccagtcataacattcttgggattcattcattcaacacatagttattgtgctcctatttgctaggcattgttctagttgacagagcagtgaccaaagcaggaaaaaaaaaaattcgctaatggaatttacagtctagcagggagaatgtttaacagacacatgagaaaatcatatttcatgtcataggatgtaagtactatgaagataaataattagggaagggagataaggagtactgggatgctagtttaagtaagatggtcatggcagacttctttcacaaggtgatatctgaaggagatgaaagagaaagccgcagggatactgggtggaagagaaatcctggctgaaggtgtagcaagagccagaccttgaggcaagacacatattggagaattcaaaggataggacagtggagttatgattcaaatgcaaaacaatagactcaggacattgagctcagggtcagacttagagggtcctgaacacaggtctagctgactccaaagtcagtgcacttttacaaataaccacatgtgctactgactgctcatctactatgtgtcattttccaaactcttgctctaaatatttgatggccatctaacgttttctggttaactaaaagagtcaaattacccctgctagaaatcacatttcaaaggaaattgtcaacaaaagaaatacactcaggactacaagctttccaaacattaataagaggcaaatatgtctagtgcattactgtttcaattaattaaatgattagtgagatagcactggagaatcattttcactataaacgaaatattttttaatctagtgtaagcagtaaagtcactagagaggaaagtaatttttccagtttcctgatttaaaaatttctttctttacgataaaacgtgatagcaccagagagcctttggcatggcattatgcactgtgtagacctgataccctgaagctttgtatttcatgttacctttatgaggcggaaagtcttcacactggccagatatgtgcttgtgaaaaggttgggtaaaaacagtgcaatcattacagtggttttttcccgaatgggttttttttgttgttttttttttttgctcataactggtcctttggtgccctctggtgatacagctcatgaaaacaagtactagatcgctaattctctctctcacactatagtattgccatctaatgtacacagtttacaacaccaaaatgcagaaagaaaaattacccacaagaataattgtacacttatcagtttatttagtcttgcctcacataaaaattgctaaaagctttgagttgagagtggtaatgtaagagaaagcaatctctaactttgtggggttttttttttgtttgtttgtttttttagtttttagaacatgagacaccttctcactctgtcacccaggctgcagtgtagtgatgtaatctgcactcactctggcctggacctcccaggctccagcaatcctcccacctcagctccttgagtagctgggaacacaggaaggcgccaccccgccctgctaatttttgtatttgtagagatgagatttcactatgttgcctgggctggtgttgaactcctgagctcaagtgatccacccacctcagcctcccgaagtgctgggatttacagatgtgatccactgcacccagcagcaatgtctaacttcataaactgagactatgctaatcagtgacaaagaacaaaatttttaaatttctaatagactaacaaataaatcagtcttaccacttctctgtgcagattgccagtaaatctcctttcattgaaacaaggcaaataaattaaacatggtgaataacccactgacagaaagcatggtatttttctgggcaatctgaactacaaattggctgacaacaggaaacagtatggccctacactacatgattttctatcattaaaactatggaaatattttccttgtcctcatgtcctcatagatatgtctcttttaaatagcatagagctggatttttaaaatccaatctggtaagctatttaaatttaaattggtggttatagtgattaataatgtagttgggcttgttttgcccctcttattcatgtataatgtatttttatacttgttttgttcatattgttttattttgaattaattgaatctttgtctttattttattattttgtattcattgatttaaaaaattttatgttaaccttgaaatactgtcatgcagatttaataaattcttaagctaatgattcttactagttaaaaatgtaaagtattaagaatgtgagctccacgagagctgggatttttgtctttgtccattgctgtattcccagagtcacaggatccttggggtgttgtcgcttttccagccagaaacctctgtggctgctggtgcctttgcccaagttttgctcaggcctgctgggctcattctgcccacttagcctggcaggctgtgctcgactcgcgttactggcctggatccctcacctgccaagggcaaccccagtgcagagtattgagtggtgtgtgagcaagcgagtgtggggttcagtcactgcacacactgaggtacgcctgctgtggtggggtggacagctccaggtgttggcaagggtgctggctccctgctagactgtggctggaccaggcataccacaagcatcttccatggctggcacgggggaacatggtggtgtccacaagcttggagatgccaggaactgcagacccccaatgagggcctcacagccctggcttgggagctcctagatctgggctcctcgaaaggctgcaggtcttctctttttctctcttctttcctccttgttgcctgcaatgtggtgagcaaggggcatgtttcagccctgcttgtgttacagctctttcagccctgccatatttggcagttcctgagttcttgtcccatgtccagaaagaatgaggtatgtggacaagtggagagtgagcaaggcaaagagatgcttaattgagggacagagcagctcagaggagaccacagaggtagctcctctctgcagccaggtcaacctgttgtctgcagccctcagtggagaggaggcccagagttggtagctcctatccacaggcaagttgtcccatcctctacccaagcctggctgagtctgggggttttatgggctttagaggggagatactgcatgctgactggtccgtgggcagccgtgggcaggcccagaaaaagcaccataagttttctatccagtctgcagaactgataacctgacccccaggcttcactctgtccctggcttgaaggtggggcttcgctgggtgacctgctcctttgtgcccaggagtgtgtctacctcctgccaccatcaacctgccatgcacagtgcccaggctgtttgtgccaaggggtgcctgtaggccctgcactgagctgctctcagcccccacctcagcctccctcctgtgcttgtcagtgcccaaagtcggatgggggctgaggtggcaggggcctggcatgtcagcactgcctcaagcacacacacacacccagctaggttgtgacagcacccaggctcatcctcaactttactacagaataggagtgggtgccagaagcagggagaggccaggcattgggagcaggcaattccaagcctgagggggcaggagggtttcctgggctctggagagcacaggtgttgggaacaggcccccaaaatccggccataaactggccactaaactgaccataaacaaaatctctgcagcactgtggcatgttcatgatggccatgacacccatgctgaaggtcatgggtttactggaatgagggcaaggaacacctggcctgccctgggtggaaaaccacttaaaggcattcctaagccacagactagcatgagcaatctgtgccttaaggacatgttcctgctacagataactagcaaggcccatccctttatttcggcccatacctttgtttcccataaggaatacttttaattaatatataaactatagtaacaatgtttatcactggcttgctgtcaataaatgtgtgggtaaatctctgtttgagactctcagctctgaaggctgtgagatccctgatttcccactccacatgctatatttctgtgtgtgtgtctttaattcctctagcgccgctggattaggtctccacgcctgagctggtctcggcaagtggcgcccaatatgggaggtttgaaaccaggtcaaagggtccccggagtgatggttggagaatgtggaactatgctggaggacacctgagtactcttaagcaatccctatggtgagtaagaaggggagctcggaagcatcagtgtaacaatgggacaagtgtgggctctggttcgttccaccttggaaccttttcacactgatgatgaggagaaaggagagtataatgaagtaacagaagaagtaacagagcaagtttgtttgcctgctaaagctaaagtggcaaaggagggagaggtttatccctatccttctgcaccccctccttattttgaagaaaaagagtggcctgaccctccagatctttcttttctggaggatgctgggcaaaaagtgattgccccagtgactgttcaagcagcgcctcaagcgatcgctctcagttctattcaggcaggaattcagcaagctagaagagagggtgatttagaggcttggcagttccctattagaatacaccccccagatcaacagggaaatattatagctacatttgagccttttccttttaaattactcaaagaatctaaacaagctattaatcaatatggacaaggttctccttttgtaatggaactgttaaagaatgttgctgtttccagtcagatgattcctactgactgggatgctcttgctcaagcttgtctaactcttactcagttcttacaatttaaaaccttgtgggcagatgaagtttccattcaggctgcttgtaatgcctaggcccaacctcagattaatataactgcagaccaacttttaggggtcggcggctgggctggtttagatgcacaagtggtcatgcaggatgatgccatagagcagcttagaggagtgtgcattagagcttgggaaaaaaatcacttcaggaggagaacaataccctccctttagttctgtcaaacagggaccaaaagaaccatatgcagattttatagcgcagttacaggagtctcttaaaaaggtgattgcagattcagctgctcaggatatagtgttgtggttattagctttcgacaatgctaatcccaattgccaggctgctctgtgacctattagagggaaagcacatttagttgattttatcaatgcctgtgatggtatcggaggtaatctgcataaggctactctgctagcccaggcaatggcaggactgagagtggataaaggaaatactccgtttcctggagcttgttttaactatgggaagcatgatcataccaaaaaagaatgtagaaaaaaatcagcgagtcaggctgccaaatagggagaaaagaaaactgctgagcctgaaatatgtccaaaatgtaaaagaggaaaacactggactaatcagtgtcactctaaatttgataaagatgggaacccgatttcaggaaacaccatgaggggtccctcctgggccccgttctaaaccggggcattccggctcagaccattccctcaccactgtacaatgtctgtcccctgccacagccggtagtgctgcagtagatttatgctgcacaaaagctgtgagccttctgctcggggaacccctgcaaaaggttacaacaggggactgtggacccttgccagcggggatgataggattacttctaggcaggtctagtttaaatttaaaaggggtacaagtagaaacaggagtcaatgattcagattacatcggggaaattcaaattgttatatctacttatgttccctggaaagcagagccaggagagtgtatagcacagctcctgattgtgctgtatgtggaaatggggaaaagtgaaattaaatgaacaaggatttggaagcacaaataaacaagcaaagcagcttattgggtaagtcaaattactgataagtgtcctacctgtgaaataactattcagggaaagaaatttaaaggtttagtagttacaggagtggacacttcaatcatttctctacagcactggccatccatgtggccaattccacctgctcaatttaacatagttggagttggtaaagcccctgaagtatatcaaagtagttatattttgcattgtgaagggcccgatggacaacctgggactattcaaccaattataacttctgtacctataaatttatggggaagagatttattacaacaacgaggagcacaaattctaattccagaataattatttaaccctcaaagtcaatatatgatggatgaaatcgggtatgtccctggtatgggactaggaaaacatttgcaagttttgaaggaaccgcttcaagcagaaagacaaagttccctccaaggtttaggatttgatggtggccattgttaagcctccagaacctatacctttaaaatggttaacagataagccaatttggatagaacaatggccactgagtaaagagaaactggaggctttagaggacttcattactgaacaattagaaaaaggacacatagctccaacattttccccttgcaattctgcagttttcataattaagaaaaaatcaggtaaatggagaatgttaactgatttaagagctccgttaattcagttatacaacctatgggagtattacagccaggattgccttctcctgccatgattccaaaaaactggcctttaatagtcatagatttaaaagactttttttttttttttactatccccttagctgagcaggactatgaatggtttgcatttacaattcctgcagtaaacatcctgcagcctgctaagtattttcactggaaagtgttgccacaaggcatgttaaacagtccaacaatttgccagacatatgtaggggaagcaattgaacctactcgtaaaaaattttcacagtgttacattattcattatatggatgatatactttgtgctgcccccactggagaaatattacttcaatgtaatgatcacttgcaaaattcgatttcttgtgctagtttaattatagctcctgacaaaattcagactactccttactcctacttggagaccttagtaaatgacactaccattgtgcctcagaaagtagccatacgtagggatgaattgaaaacattaaatgactttcaaaaattactaggggacattaattggatacaacctgctgtaggcattcatacctatgccatgagttatctattttctatccttggaggagatcctagtctcactagcccttggcaattaacaaaagaagctaaggcagagctgcagctaatcgaaaagcaagtccataaagctcaaataaatagaatagatccagagaagactctagatttgctaatttttccaactcagcattcacctactggtgttattgtccaagaacaggacttagtagaatggctttttcttccacatactaattcacagactctaactctttatttggatcaaatcgctactatgataggaaatgaaagaacttggattgttaaattacatggatatgatcctggaaaagtttattatccctctcacaaaggcacaaatacattaagcttttataaatagtcttacttggaaaacccatttagctgactttgtgggtattctcgataatcattttcctaaaatgaaactgtttcaatttttgaaattaactaattgaattctcactaagataactaaatttaaaccaattgaaggtgctgagaatgtttttacagatgcgtctggtaatggtaaagcttattctggctcgaaaggtaaattttttcagatgccttatacttcagctcaaaaagtggagcttatagctgtacttgaggtattgactgcttttattatgcctattaatgcaattcctgattcttcatacgtggttcattccacacgattaattgaaaatgctcagttacgatttcatacagatgaacaactgatgactttatttatgcaattgcaaacagcggttaggagtagaatgtaccctttttacatcacttacattagggctcatacacctcttccaggacctttgactgcagggaatcaaatggctgatcaccagttgctaatgcaatatctaatgctagacactttaacaatttaacccatgttaatgcctctggtctcaaatgcagatacaacattacctggaaagaagctaaagctattatccagcgatgcccaacttgccaaattgtgcattcctcatcttttactggaggagttaatcctcgagggttggaacctaattctctttggcaaatggatctcacacatgttccctcgtttgggagactagcttatgtacatgtatgtgtggacacctttactcactttttctgggctacatgccaatcaggatagtcttctgcctgtgataaatgtcaccttttgcagtgttttgtggtgatggacattccagcttctgttaaaacagataatgccccaggctatactagccaagctctagctacatttttctgcatatggaatattaaacacattactgatatcccatataattctcaaggacaagccatagtggaaagaatgaatctctccctgaaacagcagttgcaaaaacaaaaaaagggagagaaacagggactacaggacaccccatatgcaactgaatctagcattattaactttaaattttttgagcctgcctaaaggccagatgttatcagcagctgaacagtatctacagaaaccagctccaaagacagaagcagaacaactggtttggtggagagatctgataacaaaaagttgggaaataggtaaaacaacaacttggggtagaggttatgcttgtgttcctccaggaccaaatcaacagctgatttggataccatgaagacacctgaaaccttataatgagccagatgctgaggaagagattctgggaggatcccgaggaccccccagttgcagccatgtcaagactgacagtgaggaggaccccagctgttacgggcaacacccgttgaacacagctacccacctggggacagatcaagaagctattacagatggcggaagaaaacctgaggaaagccggacagccagtcacaatgagtaatttaatggtagctatgatagtggtgatcaccattgctgtgagtattccttcaacaagggctgacacagagaacaattatacatattgggcatatttatcaatcttggctggcaataatgcctggatgtaatcactctatgacacagttacacatgtttctgatcttagtatttactataataaatctgctcctataattgaggcatacaaccctcaaaaacctatttgtaaacaggattggacctggccagaagtaatgaacatacttgtttgggaagattgcattgcagaacatacagaggtgctatgcaacaattcctatggaatcattattaactggtcccctaaggggacatttagcttgaattgcacctctcagtctgcatgccacggccacactgtgtttagctggtctgaacaaaatggtcagatggtagaaatagtaagaaatatggcaagagttcctattatgtggaaatatggcggtatagtggcacctcaatctcaatctgatatggcccgctctaggagctaaacataaggatttgtggaaactattaatagctctcaataagatcaaaatttatgaaagaataaaaaagcatctagaaggacattctacaaacttgtctttgaatattgcaaaattaaaagaacaaatatttaaagcatcccaggcacacctgacctaaatgccaggaactggagtgcttgaaggagctgcagacagattagcagctagtaactcattaaaatggataaaaacacttggaagctctgtgatttcaatgataattgtgcttttaatctgtgttttttgtctttgtatagtctgcagatgaggatcccaattcctgtgagaagtagctcactgggacaaagctgcctttgcttttatcgctttgcaaaacgaagggggacatgttgggaacaggcccccaaaatctggccataaactggccccagaactggccataaacaaaatctctgcagcactgtgacctgttcatgatggccatgatgcccatgctgaaggttgtgggtttactggaatgagggcaaggaacacctggcccacccagggcagaaaactgcttaaaggcattcttaaaccacaagcaatagcatgagcgatctgtgccttaaggacatgttcctgctgcagataactagccagacccatccctttatttcagcccatccctttctttcccataaggaatacttttagttaatctagaatctatagaaacaatgtttatcactggcttgctgtcaataaatatgtgggtaaatctctgtccgaggctctcagctttgaaggctgtgagacccctgatttcccactccacatgctatatttctgtatgtgtgtctttataattcctctagcaccactgggttagggtctccatgactgagctggtctcggcacacagggatgcctgggtccgcagccctggctgagcagctgcagctgcaccctggagggcggggctcctactcctcaaaatcagaagtgggtgaggcttctgcctgttcctggctcctgctggatctgtggagcatacagccctggccacgcctcccccactgcagctggtgttttcacagcggctgctccagatgggccactgctgccatcaccagcacctagaaaacttctgggcaataaatggacctcagaacatcttagccacattcacctgctcatgacctaatgctgctgttgtccattattttacttctttcttagacttaacaaaagttggacatcattctcattgtgaaccctgaatatctgagacatgtctcagccaatttaggaagtttattttgccaaagttaaggatgcacaccggtgagaaaacctcaggaggttttgataccatgtgcccaaggtgatccaaacacagcttggttttgtacattttagggagacatgagacatcaatcaatatatgtaaaatgaacattgatttggtctgaaaaggtgggacacctcaaagaaaggtgggacaacttgaagtggggaggggccttccaggtcataggtagataagagacaaatgtttgcattcttttgaatttctgattagtttttccaaaggaggcagtcagatatgcatttatctcagtgagcagaaggatgactttgaatagaataggaggcaggtttgccctaagcagttcccagcttgacttttccctttagcttagtgattatagggcctgaagacttatttttctttcacatttcccctgcttttcttttaaaaatctttttggaggaagtattttaaaagaaaatgaatctctggtctcaggttttgtctgatctgtcatggctaggatggtttattcctagacaggaaggtcctgagttattaggaaagctcattttaacaggttatgaagtctcatgtcctatgaagagaaaatagggggaagaagggacaaaacaacaaacaaaagagcaatcctggaagattgatataggccacattactcggaagtccatacattagtaggcaggtatgaaagtggcttatgtatttaaataggtttctgttattttcttctgaagtttaagttgcctggctttagttcacagggctttaagaaaacacagcttagttttcaacaatttcgaattgggaaaaataggggtaaaaaggaaaagaaagaagaaacacattgaaaacattattttggagacattattcattatagccaggaaaaaatataattcagtccaaactgtagaaaataataaaaatggaaaaacattaggcaagactagaatctaacaatgggtgtactatagtttttgaatttttctctctccagtttgccatttttaccaaagacaaatcatggtaggagtgatttgttttattatacttggccagattatttgtacaacatgcagcaggaataattatttttcacaaaggctttttaattttgctttgttaattaataatttattattaattataattaatcattaatcatcaatttattaattaaatggagctttgtttcatagaaagaatctcagataagactttttaaaagcccagccatggatttgcaccatcaaatatctatgagttgggtaaattcctctcctcttgaggtcccaagaaaacttgggactcctgagcctgtcagaaagtgacattctttacttacaacaggtcaggaaccctgtacagaaactgtgtaggcaaggtatgaggccagttttcccaagaggcttttattggttctataagtcaagcttgattccttaaaggaaagcacaccattccagtcaaagccttggtaaaataaccagtttatccaatgatgtcctgttgcaaaagaaagtattatttgcacttatgcaaataactgtattgctgtaaattaagaatactcacaaaagtttacaaattctggagaattcaggtagaaacagatatgctccaaattttgttcacaggagtatactttactcaattgctacaaactgtaaatagctcaaaggaaaagttttcttgtttctgaaaaacaaaacaaaggatcagcaatgttttaagcaaaacgtcaaaagattaattcagtcttctattagttcagtccatacagttagctcctcttctgcatgatattcatggacattccatctcaccataagagtcctgaaagttttcctctattttaatgtcacaatctccaaagttatcataaacctgtgttgaagaacacctgttagagttttatagctgattataaagccaccttctaaaaaggaccaaaacaagacaattgtttgtcaatgacaaaaagttttaaggcagccatagtcaaagacacacttgacaaggaaattttttacctctgtggcacacgataatttaacataacaattatagttatgactgataatgtgcactaagtcatatcagaattatagcagtttcccataatgttggaactcctaccagtagcatatttatagaactatagcccaaagaaagccaaataacatttcatatttgacaatgtttcctgtatgatttttatgccaaataagccaaatatgtcattttttgactttagtgaacctaataccatgaaagattaattaggtcagaaaaagacataatttataatttgattttggaaagtttgtcaaatatcaaaagtttaaaacacttgatattacaaaataggatcacaggtcgttgtaaaataagtcattcatttaaccaaagtaataaggatttcaaaaaaaagatgaaaatcttcattctttgagagaggagacttactttttcaaaaaataagtgcaataaaacatcgtgaagccagttaaatttgttttcaaaaatttatacacaatctataaaattttaatcatcttgacgtaagatataatttccgtaagtcttttataacctttattaaggagttggctaatgcttcaggaaaaccttgtaaatctgatactggggcccatatgctgtgcttgcatcaatgtgcctttgacattaatggttactttatagagaaactgaacttactttatctctcaaaattggcccttagaatctcatgtgctggccacttccacaataattcctgggccttgaggagttgaatagctttaatttctggccctgtgtctcacaaacacagtttattttgattggtatcttctatggtgtctgaagagaggctttaattgctgtcagtgataagattcagcagaacttggtgtccttttagacccaggagtcaaagccctgtaacttattggcacaaggactttaaaagcacataacagaaagttataagggtgtagtaactgtagttttaaaaaattgtttttaatctcagtttttttctaagtaaaccagacatagtaataatgatataggaattatttcaatgatgcacaagatctgtttattaggccagttacccaaggcaagagaaaagatcttctgcaatgtgactgctgttccctatggggaatattctgttggaaggaaacatttcctttagacctttaagatgaaattgttttttgttttgttttgtttttgcatcaggccacaatagttagaactggaaaaaaaataacttgcaggagctaaaaatgagttgaacatagagttattatttcaagccttttaaaaagggagagaaagccaaaaacagcaaaatgcaataaaagttgaactttgcataaaaaattataatgtcttttaatttattatgagtaaagcaattagagctgggcatggtggctcacgtctgtaatcccagcacttcgggaggtcaaggtgggtggatcacttgaggttagcagttcaagacaagcttggccaacatggtgaaaccccatttctcctaaaaatacaaaaattagctgggcatggtggcgcacacttgtaatcccagctactcaggagcctgaggcagcagaatcacttgaatcaaggaggcggagtttacagtgaaatgagatcatgccactgcactccagctttggtgatagagtgagactgtgtgtcaaaaaaaaaaaaaacaaaaaagagtaaagcaacaacttaagaacatggcatactttgaaccaattatttagggtataagtagtttttttaaataattaaacacaatctctagataattgataattaaaattatagacaaaatgatcataaaaaagttgtccttttaaataaatcctcttattgtgtcttacacagaccattcataacatgcttggacattcttgtttgtcatgagcatccctcttttttaaacaaccagacgttttattttaggacaaagtttaccatacaagattccttctcatataaaattatttctctttaaccttcttaccaaaaaatacctctttatttctataactttctttacatctctatttatttcctggtatcttttaccttgttttatacataatcttgaaataagctttgaattagacaaaagtattcacctttttaaaaaggacacgtattgtatttttagaaagaatgttttcctacaatatattttaattggaaaatacccaagtaatgaaatagctattatttaatataactttagattctaaattatgaaaagtttgtctacaagtatttaccccatacatttacctaattatttcattttaattgtttacctagattatgaaaactgcaatagtcatcacttaaagttatgaaactgccgttgcaaaattataattgagacagtgaaaaacatctgacctaactgactccatcttgcttctaatctccaagctgtccttgttcattcctgggcatgggccgaactaacttttggaggaatttaggttataatttagctttgaaacaaagacaataacagtcctctcccaaaacaaacccccttcctgcctggggactaaactgcctaaagccagaagattagaagttatggttattttactaaataattcaagatttagctattgtcattaaaccaatattaacgtcttatttatcaaaagctacataaacaaagatcattctgttttgcactgggctttacagttttgtaacccctatgccaaattttgagaactgatagtatttggcaggggtaagtatgaaaatgcttgattaataaatacaaacaaaaatgtatgctggaaactcttaagacatttctaatattactttatcaaaaattttaaagttagcttatttattaatgattttacttaggtcttgaaaaacttgaatttgaaaaagcatttgactagtctttccttttttctaatgaagtatttgatttaagcacttttatttttccttaagccaattacttagagctctttcatatatttttaatagtgaaacattgtgtacacaacacataaatacatagatgcattaggcatatcaataaaagtacaccttatagattcataagacctccctttttccccctatttaagacatgcaaattcttgaaaacctgtttcattatgctggcagttgtcaggtaaatagccctaaatctgcgtattgaaggaaacaactcttaggtgaaaaatcaaatagcaaagtttacaacccaaggtacagagagaaaatgtctgttggtgctagagggaaattaaagatggatgccaaatcaaacgtaaaaatatacagaaatctatcatagtattgtataaggagactaatttaatttagatagggactacttgtcacttaactagatcgctgagctctgggcagagcccatacagaatcctgggtctccaaaaagggagaattattatgaggctagaacatgcgatgcttgtacagtgcactaaaaaaaatttttttttaaacaaagacatttcattttttaaacaaagacattcttccttaaaaacccaagagtagcctctgttgcaactattttagtcaaaaaatcaggtaacgtagtacaaaagcaagcagtttaagagctgagacgaatttgcctgtttacactcttggagttccataaggaaaaacagcagctttttcccacaaggaagtctggcaccttctccattttctttaaggaaccccaggctattataaactattttaggtccctcttgcagcacagggttcaagagaaaggagagacagcagatgtaaatgaagaaaacagaattcagtcaactgagaagaaaaaaacttttgctcaaaaaagacaaggtcctaggagagagaaaaacaaaacaaaacaggccttttaaattcaaatacacgcacacacagacatacacaaacacagcttggatgttagcttttaattaaggtgacttttaaccgttgaactcctttaaaaaaatcttttaaaatcttattaccatatttcagcgaggtcaaattgctgctattttagaagtaccaatattaatggaaaggagtcctgatccagaccccaatagagggtttttggatttcacacaagaaagaattcaaggagaatccatacagtaaagtgaaggcaagtttattagagaagttaagaaacaaaagaatggctggctactccataggcagagcagccctcctgatggctgctgatagttatttcttgattacatgtgaaacaaggggtagatctgattcatggtgccccttcttaaaccatatggagcaacttcctgatgttgccgtggcttgtgtaaactgtcatgagtgtagcagtgaggacaaccagaggtcattctcattggcattttgattttgttgggttttggccggctttttactggaagctgttttattagcaaggtctttatgacctgtatcttgtgttgacctcctatctcatccagtgatttagaacatctaggaatgcagcccagtagttctcagcctcatttcacgcagcccctattcaggatggagttgctctgattcaaacacctctgacatcaagcatcaaaccagaaagggcttgatttagaaacgaaacccaggctgtcatagtgaaaaaaaagaaggcagaaacttagctatggaactgcagcatagggccacaaccattgctctttcagtttgacctgaaagagcaaaaaggtggctttgttatgtaaataaagctccttaagtagtcaaaataaaaaaaaaaaactttacttttttttctttttagtggttgtttttctcccccaccacacctttttgttgatgttgtttgtttttgtttttgtagcaatttagccacttcagaggccttgtttcccataatttggaactttcctttagatttgatcaaattggatagagctggtcaaacccaataggaaaaagactgaaacaacaacaaaaacaggaacaaaacaaacaacgaaaaagcagttaagcgaaacaaacaaatgattgcacaacttataccattactgagcgctctaatggtaaggaaaaattaagaccagctggttgttaatcttaactttagccaagacaaaccccaattcagttacttaccttggggtgggtctcaggctgaagattgctctctaccttcctagaagcaggaaaaaaattcaaacttgccttccctgttgggagtgatttcaaactccagaaaggagttacctgccttccatcaccatggaagcaggacaacttgccctccctccttgttggaagtcagtaaaactcaaaaaaaaaaaaaaacagttgtacagcaaaataaacttcatatctcaaccaaatttggggagaccagggatcctctggagggagaggcttccaggcctcagcaaattgtcctattggtttgagccataaagataactcgagctggtaccaagcactgataggagatttgtcaaaggtcaggggtatctccactcagaatcccttcatggttaccaaaatatgaaccctgaatatctgagacagatctcagtcaatttaggaagtttattttgccaaagttaaggacgcacacccaaagttaaggacacagcctcaggagtcctgacaacgtgtgcccaaggtgatccgagcacagcttggttttatacattttagggagacagacatcaatcaatatacataagacaaacattggtttgattgggaaaggtgggacaactcaaagcaaagttgggacaacttgaattggggagggggcttccaggtcataggtagataagagacaaatggctgcattctgttgagtttctgattagcctctccaaaggaggcaatcgggtatgcatttatctcagtgagcagaggggtgactttaaacagaataggaagcaggtttgccctaagcagttcccagcttgacttttccctttagcttggtgattttaaggccccaagatttattttcctttcacatcgtcataatcactacaagcaaacgtctttgttgagatttacttaaatatttaccattttcttaactcaccattacttcttgctttccatgtcttttttgaagtccacatattaaatacttcttcaatgaataatgtccggtggtagtgctcttagtttttgcttaatcctcccgtataattattattctattagttcttaaaattctacttgactctcttaaaattttcatgaacttttttgactttcttggtccttgcctattaatttagttccaacttttatttttgaacattttatacattgccctagaaaaattttgtatctgaaaattcttatcattcttgtatctaaagaccttttattttacctaccgactatcctttacaatagtttatttcttgtgtattggtgatttaaaaaacattgggagcctacatctggtatgacttattgtaaaaaggctgagtgctgaaactggtgacttttctaacaagaatttgcatttgctctgcctcggcccagtttgttgttctgacctggaaacattaaatgtttccagaggctgtggcttaacatgggagttccaaatctccccaccctccccccatgcctttctgcagactcctttgactagtacatttgccttaattatcaaagaaaaatgtggttgcagatacattgtggagcaacagagaaacatctggaagtcaggagactgaggtgcctccaagtactaatgataaaaattaacaaaataatatagaaatcccatacaggcaggagcagccaaggcacaaaggaatgaagccttgggccaccccaccaggtaaagaaccccaaccagttgaggtgcaaattgggagtggaggaaggacattgtacatttcaactaagccttcctgattagttacagaaataagtattatagtagctgtcaatattttcttctttgcatgatcaggcatatgtttacgtaatttcccttttctatttgtgttgcctttggctaactttactctgagtttgaaatataccgaatatcaaagtaggagtataaccaaattggaagatgaataaatgaatgcaattactgacgagacttgggtctttttttttcagggacagagcaaacatttttatttgaatgaaagataatctcattatgttaggagaaaatgcgttgggtttttttttaatacacatgttgaaagaatgacacatatggacattgtgttgtcaaaggggtggactgccaaggaaaactgtggattgactatggcaatacccattcctacaactcttcagtgtgcagagactacagaaataaaattatgtttttcagactcacttgtagctagtgttcactgcagctagtgatttaggttctacaaagcaaatgtactcatttgagattgattcagaacatgagtcaccagaggacagaggcaaaatgtggggcacccattttcctgacacaaattatgtcagcaaattaagatgtatttctgaattaactgctatagcactggcactctgaccatggcagagacaaaaacttcattctttgtccagtttgatggtgtcatttgggaaattgtttctgcaaacttagcctaaagactttttttaactcatccaccagttctgtgtactatttagatagccctttataatccctttctcctaaagtacagcagattacattgtttgaaatgaaaaacaccaaacactggacaatattatatatgggactgtacacagttactgacagatactctaatccagtgttgtcaagagatgagagattggcctctaaagataaatgagttcacctgaagcacatgaactgtggttacttctaaaacaaggttgctatgtgtatgaaccttgttttaaaagtaactacagttcatgatctccaggttataaccagaaatacctggaagtggtacccactgtgcaacctggaagagcaatagtgaacagcttgatcctgaggaggcatgttatggcctaatcccactcccccaaaattgattgtcagagaatggagaatttatcatttggatacacacatatacaaacacacatgcatatttatactgcctattatgttatagtttatgcttctataaaatataaatttaaaattgtatgtagatatgtattctagatatattaaaaatttaatattttctagcctgtattttattctacataatgaaaattttactgttgttaaatattcttctacaacatcaatttataattaccaatatgaactaaatcagtctattgtttgtcatctgagatttttgaagtctaatattaaaaacatttcaacaagtatcttagctataagtatttgcatatgttagcatatatttttgatgatttccctaggaaaatccctacacagaaattgatgggttagtagaatttttttttttttttttttttttttttttttgagatggagtcttgctctgtctcccaggttggagtgcagtggtgtgatctcgggtcactgcaacctccgccttctgggttcaagcaattctccctgcctctgtcttccgagtagctgggattacaggcacttgccaccacactcggctaatttttgtattttttagtagagatagggtttcgccatattggccaggctggtcttgagctccatacctcaggtgatctgcctgcctcagcctcccaaagtgctaggattacaagtatgagccaccgcacccagctgaatattttatgaattttttgtattatgtattgccagactgacttctgaaggggttagggcattttttaagtcacctgacaatttatgggggtttccatgtctttgaaagctcaccaaaactagattttattattttcttacaaatttccaatttgttggtgaaaaaacatttacctaattttaaattttatatgtttgattcttatgagattgacatgatttaatgtttcttttctctttgcgtttcttcttggtaaattgctttatcatgtcatttactaatattgtcccatgatcttaaaatctttttcttttttaaaaaaaatttttttttttttttgagacggagtcccgctctgtcgcccaggctggagtgcagtggcacgatctcagctgactgcaagctctgcctcccggcttcacgccattctcctgcctcagcttcccaagtagctgggactacaggcacccgccaccatgcccagctaattttttgtatttttttagtagagatgaggtttcaccgtgttagccaggatggtctggatctcctgaccttgtgacccgcccgcttcggcctccctaagtgctgggattacaggcgtgagccactgcgtccggccttaaaaataatttcaagtaattttagattcaggggagacatgtgaagacttgttaaatgagcctattgtgtaatactgaggtttgggcttagtacccaacaagtagtttcttagccctatctcccttctccttctcccctctctagtagtccccagtgtctgttgtcatgtttatatttatgtgtacccagtgcttagctctcacttacaagtgagaacatgtggtattttgttttctgtttctgcggtaattcgcttagaataatgagctccaggtcagtccatgttgttgcaatggacatgatttcgttcttttttatggccatgtagtgcctcagggtatatgcactacattttcttcatccagtccactgttgatgggcatctagcttgattccatgtctttactcttgtgaatagtgctgtgacgaacatacaagtactcatttagtagagggatttcttttactttgagtatatactcagtaatgagactgctgggttaaatggtagttatttgagaaatctctaagctgctttccacaggggctgaactaatttacattcctaccaatactatataagcatttccttttctctgcagtctcaccagcaatctgttcttttttgactttttaacagtagccattctgaccggagtgggttgatatcttcttgtggttttgatttgcatttctctgatgcttagtgagattgagcattttttcatttgtttattggctgcttaaatgtcttctcttgagaagtgtctgtcatgtcttttgcccactttttaatggggtaatttgttttttgcttgttgaattctttaagatccttatagatgttggatatcagacctttggcagaggcatagttttcaagtatcttctgcccttctgcaggttgtctgtttactctgttggtagtttctgttgctgtgcagaagctctttaattaggtcccacttcccaatttttgtttggtgcaattgcttttgaggatttagtcatgaattcttctccaaggcagatgtccacaatttactagattttctttcaggattcttatttaaggtcttacatttaaatctgtaatctgtcttgatataatctgtatatatggtgaaaggcagggctccagtttcattcttctgcatgtggctagtgaattatttccccattgcttattttttgtcaactttgtcaaacatcagatgactgcaggtgtatagctttatttctgcattctctcctctgttccattgatctatgtgtctgcttttgaactagtatcgtgctgttttgcttactgcagccttgaagtacagttgaataatcgataatatgatacctcctactttgttcttattgcttatgattcctttgcctttatggctctgttttttattccatatgaatcttggaatagatttgtttaattctgtgaaaaatgacattggtagtttgaatggaatggtgttgaatctttagattgctttgggcagtatggccattttaatgatactgattcttccaatccatgcgcatggaatgtttttccatttgtttgtgccatctataatttctttcagcagtgtgttgtagttctccttgtagggatcttttacctctttggttaggtgtattcctagatattttattttattttttgtgcacattgtaattgacatcacattcttgatttggctctcagcttgaacattataggtgtatagaaatgctactgatttttgtacttagattttgtatcctgaaacttttctaaagtcatttatcagttctaggagccttctggcagagtttttaggatttttcagatatagaatcatattggcagttaagagagataatttgatttcttcttttcctcttttgatgccttttaattttttcccttgtgggattactgtagcgaggactatgttgaatgggagtggcaagagtgggcatccttgttttgtcctgattcttaagtggaatgtgtgcagcttttccctgttcagtatgatgttggctgtgagtttgtcatagatggctcccattattttgtggtatgtttattcaattcctagtttcttgagagattttgccaggaaacattgttggattttatcagaagctttttctacatctattgagatgatcatatgctttttgtttttaattctgtttatgtggtgaatcatattttctgatttgcatatgttgaaccaaccttgcatcccaggaataaagcctacgtgatcatggtaaacagtattttgctgaggatatttgcatctatgttcatcagggatattggcctatagtttttgttcagttgtttctggtgcgtctttgccaggttttggtatcaaggtgatgctggccttatagaatgaagtggagtcctcctccttgatttttcagaatagttctagtagaattggtgccacctcctccttgtacatctagtagaattcagccatgaatccatctggtctgtggctttttttggattggtaggtttttttattactgattcagtttcagaacttaatattggtctattcaggttttcagtttcttcgtgattcaatcttgggaggatgtatgtttctgggaatttatccatttcctctaaattttctagtttttgtatacagctgttcataatagtctctgaggatcttttgtatttctgcaggatcagttgtattgtgacctttgtcatttttgattgtgcttatttggatcgtctctcttttttcctttgttactctagctagtgttctatcaattttgtttaccctttcagagaactaaattttgggcttgttgattctttgtatggatttttgagtctccatttcattcagttctgctttgattttagttatttattttcttctgctggctttgggattagtatgttcttgtttttccagctcctctagatgtgaggttagatcatgaatataagatctttctaatttttttatgtaggcatatagcactataaactttcctcttaacactgtttttgctgtatcccagagattttggcatgctgtgtctctgatttcatttatttagagaactttttgatttctgccttaattttattgtttgcacaaaagttattcaggagcaagtcatttaatttttcatgtaactgtgtggtttagagagatcctcttggtattgatttctgttttcattccactgcagtccaataatatgtttggcatgattttgatttttttaaaaaatttattgagacttactttatggctgggcatgtggttgatcttagagttatattccatgtgcagattagaagaatatatattcagagactgatgaatagagaattctgtagatgtttactaggttcaattgatcaagcattgaatacaagtccagaatttctttgttagttttctgcttcgataatctgtctaatgttttcaatgggatattgaagtcacccatgattattgcacggctgtctatgtcttctcacagctctagaagtatttgtttctgggtgctccaatgttggttccatatatgggtttaggaagttaaatcttcatgttgaacactttatcattatgtaatggtaaaggcctttctttctccttttttactgttgttgctttaaagtctgttttatctgatgtaagtatagtgacccctgctttcttttgttttctgtttctgtgatagatctctctccatccctttactttgagcctgtgagtgttgtcacatgtgaggtgggtctcttgaagacagcagacggacgggtcttgtttttctgttcaacttgctgctctctgtcttttaagttgaggatttagactgtttacattcaaggtcaatattgatatgtgaggttttgattctattgtgaagttgttagctggttgctttggagttcaattgtataattactttataggatgtgtgggctatgtacttaagtgtgtttttgtggtaataggtatcattctttcatttccatgtttagaactcccttaagagtctctcgtaaggctgatatagtggtaatgaattcccttagtgctttcttgtctggaaaatattttatttctcctttgcttatgaagcttagcttggcaggatattaaattcttggttggaatttcttttctttaagaagcctgaaaatatggccccaatctctcctagcttttaagtctgcagttagcctgatagggttcccttcatatgtgatctgacctttttctctggctgccttttctttagcattgactttggacagtttgctgaccttacatcttggtgatgttctttttgtatagtatcttacaggtgttctttgggttttctttatcttgatattcacatctctagcaaggttagggaaattttctcaaattcttctctcaaatatattttccagtttgtttactttttctccttctctctcaggaatgtaaataattcattggtttgcttgctttacataataccatatttcttgaagtgtgtgttcattttttaaaaaaaaatctctttatttttgtctgtgttagttcaaaaatccagtcttcaagctctgatattctttcttctgattggtctagtctattgattaagcttttaattgtattttgaagtttcttaagtgaggttttcaactccagaagctgtgattgatttctttttaagatgtttatcttttctttcatttcctggattcctttagaagtttctttgtattgattttcaacctttcttggatctcactgaggttctttgcaatccatgctttgaattctttatctgtcattactaaatttccattttgtttaatgaccattgctggagacctagtgttatcctttggtgatgtcaatacatttggatctttcatggtaatcagaattcttacacaggttccttaacatctgaagattctggcatttctaatttttgtaattttagtgcagacagaatttttctttctttctttccctataacattattgttttttcttctgcccttttcccccatttctagggggtgtgactgtagcaaatgtttggtggaatctttttgctttgcttccacagctttacgcatttcagttgggaggttttattttgcgctgtgcagtttgactgacaagccagtagctaacacttatgggtgggagctggcagtggccaatgtggccaggtatgtactagatccttgtttactgggagaagctcctattgtctcaggcaatgggctgatcatggagtgcacagtgatctgagctccctgcttagtcctagcagggagccaaatgggtggggccagactgggcaggcctgcctgcctgcaagtctcccagtggtaggcacaagaaccagcaccaaaggaaaattcaatgggtggccaccaagcaccagctgcgtgcctaggcatggaactgggaaacctcctcagccccaagttctctatggggtcggggagggagagggttttgaaggtgctggcctaaactcctaatccaggagagtgagtgctccagatgtcaggagatctgtctgggtgtgccgtgtagacggctccccagcaccacaatctctgcagaggaagggtggagatgctcaggatgttaattcaggcaaacaggtgctctgaataactggagatctgccagggcatggagtggagaggcgctatctccgtgtgggaagggtgaggcaagtcaggctgctggtctgggcaagcatgtgctcctgaatgcgtggacttatgcctgggcatggagcagagatgaccaagatgtactgtgatccctgcacagaaagggtgggcaactcaggcttttgaaccaggtgagcaggtgcttcagatacctggaaatcttcctgggcatgaagcagagagggcctccctgcacttagatctctccacaggaaggatggagcaactcaggctgccaatctgggcaagtgggtgctccaaatgcctggagatatgcctgcaggtggagtggagagggtcccgctacaccatgatctcaggggaggcaggctctggggcactcagcaatagcacatgcagaccacttccaggtcaccaagctggccctgcctgcaagtgttgtccctcgtagaaaccattgttatagcagatctcctcccaccccaggcctgcgatggaggagagcacaattccagtgcctactgctgaggtgctttctacgattctggctgtggaggcccctaccctgctccagagcatgacctccaaaatgtggcctgagactgaaatgcctgcatggccacagtgccaggtggccaaagaatgactttgtatgtgctgacattaaaaatagtgtcttgctctcagtcccgggtctgggaaattgcctgcagctttttcctggtgtctttccctctcagtgtctccaagccgctccccaagttaactccagggcttgggagaaacaaagtgcctgaattgctcagattcctggtgaaaagttgagtcacagagggagggtctctggccttctcacatactgggacttcacttacttttatcactggacactgtcacagagactgtttgccccatggtcttctccctaggatctggggtgtccttcacaatttagtggattgccattttctttcttgaattgaagctcacagagttgatatctatgtactatcttgctatttccaagtggctgaggaacatcaaaagcctctaaatccaccatcttggaaaaaaaaacccttttgtttaaattaaaaaaaaaattgttcttttcctcttatatattggaaaatatcttgggattttgcacttattacttatgaattaatcatagtctcagttttcttattttttttacaatgataatacccactatataatattattatgaagattaagaaaagtaatatatttaaattttctatcagagtgtctgatatatagctgttcaactaatgtttcctttctaccattcctacttcacttccctacatcccatgtctgtagctaaacacttgggaaactctgcagtaagttaccactcagatttggggcctgtagagttgggtgatggtgagacaaagatgaaagaagaggaccaccaaggatcttaggaggaagtaactgaaaaggttgaaattaaatggtttgtatcctccgagcagtttagcagaatcaaatcaggatttaaccccagcaccctatttctttagccatgaattccttagatggctttgtcttcttgggaacccacttcatgtgccttctatcatagagaaacagctctatcatggccatgcattaatagtgaggaaatttacctaccattttgtctatagaattataaattttatggttgaaagggaccctgatagtcattatggctacttttaggcaggcaagaagtattaacatcattttacaggtgaagcagttgtgaacagagagggtaaatatcctgaccctgggatctttgttcaattgatgtcagcaagtcagaggtcacataaaacatatacactatcctcagagaatgtaggaatcgaaaatgcagagggactggggaataacctcacttgtttgctttcagcctattaaaatgtagttctctgcattcagctaaatggatttatgagttgctttatatattttacatttaactaaccaatttttttcatcagaattagctgggttgtgctgcaaatgtgaagagtctctaaatttcaatggcttaataacagtacatgtttattttgttacttgtgatacatgtctaagacggttgcagaggctctgacctttgtaatcagaacccctgatctaggcaactggagactcaatctcagcacaaacttccaggatttctgaagctggaaaatacataaaaaattttaaaaagagtatggtgaatcagacaatgccggccttttagaccatctttgagtagaaagactatttataatctacacaatgagaacagtgcaggattatcagctatctttcagttctgaaacatccataggcctatattctcttttatcttgacaatggttgcagtcaggaataaataacaagtctgtttcttcctggaggaagtgttctttctggtgactttctaccaaaaaaccagttatttaaccttcactaacttgactttaccattgcccagaattaactagaagagaatttcagaactaccctgcaaaaagggggcatctttttaatacggtatcaataataggtctgtatagaagtaagtacagcaagaatcaggtggccaggataatttagaaagtgacactagtagaaatagtcagaggaagttggtgtaacacagggatttagtttagtgtctatcaacagaagattaagcagactacaggagtttatgcaagactaccatggatatacacatagtggcagaagtacaaaataaaagaaattaggaattaagaataagaacaattgctaataagtgagtgaatgtgtgatatacacaaacacatacacatgtgtgcacacatatatacaatttaactctttataacctccccccagaattaagtactattttatatttcagatgagaggactgaaacccaatgtttcttggctagtaagtgatggtgctgagatgccagtccaaatatatttgattctatagatcatggtctttctattttttactgagaggtattatttcatctaggccacttcttagctaaataacatatatcatctatatatgttatattatatatatttataacatatatatatatttatatttataacatatatctgatctttgttatttctttttctcctgctaactttgggtttatttgttcttagttttttagttccttgaggtgtgatgttagggtgttaatctgtgatctttctacctttttgaagtagatatttaatgctataaactttccttttagcactgcttttatgatatcccacaggttctggtatgagatgctttcattttcattcatttcaaaaaatgtttaatttctgtcttaattgcttcattgatccagtggttgttcaagagcatgctgttcaatttccatgtatttatatagtttccaaggtttctcttggtattgacttctagctttttctcaacatagtctgagaagatccttgacgtgattttgattttaaaaaatttgttaacactagttttgtggactaatatgtggtgtattgaagaatgtttcatgtgctgatgaaaagagtgtatattctgtaatttttgggtaaaatgttctgtaaatgtctgttaagtccatttaaagttcaatttaagtccaatgttcctttgttaattttctatcttgatgatgtcttgtctagtgctgtgaatgggatgttaaagtctctcactattattgtattgctgtctatttctttaggtctagtaatttttgttttgtgaacttgggtgctttgatattgggtgcatatgtagttaggattgttatatcctcttgctgaattgatcctgttatcattatataacgatcttgtctttttttttaatgttttttatttaaaatctgttttatctaatgtaagtatgggctattcctgcttgcttttggtttctgtttgcatggaatatcttctccatccctttactatttgtgtctttaggggtaaggtgttttgatgaaccactagttagactacccaagagaagaagagagaagatccaaataaacataatcagaaatgaaaaaaggacattacaactgatactacagaagtacaaaagatcgtcagagactattatgaacaattacagagtcacacactagaaaacttagagggaatggataaagtcctggaaacacacaagttcctaagattgaacaagagaaaaacagaactctcgaccagaccaataaagagtagcaagattgaatcaataataatcccccaacaaaaagacacccaggaccaaatgcattcatagccaaattcttccaaacacacaataaagaactaataccaatcctcctgaaactattccaaaagattttgaggaggagggaattgtccttaattctttctacaaggccagtatcaccttgataccaaaaccagacaaggacataacaaaaaaagaaaactacagaccaatatccttgatgaatatacatgcaaaaatcctcaacaaaatactggcaaatcacatccaaaatcagccccaaaagataatacatcatgatcagctgggatttatccaagggatgcaaggattttttttttttgagacggagccttgcactgtcacatggactggagttcagtggcatgatctcagctcactgtaacctctggctcccaggttcaagcaattctcctgcctcagcctcctgagtagctgggattacagatgcctgccaccatgcctggctaattttttgtatttttagtggagacagggtttcactatgttggccaggctggtcttgaaagcctgaccttgtgaaacacccgccttggcctcccaaagtactaggattacaggcgtgagccactgcacccagccaatgatatttaacatctacaacttcaaccaaattaaggataaaaccatgtgatcatttcagtagatgcagaataagcattcaataacattcagcatcactccatgataaaaatcctccacaaactaggcatagaaggaacatatctcaacataataaagaccatatacaacaagcctacagccaacatcacacttaatgtggaaaagttgaaagcctttcctctaacaactgggacaagacaaggatgcccactttaaccattcttattcagcatagtactggaagtcctcaccagagcaatcagacaagagaagaaaaataaaaggcatccaaattggaaaagagaaattcaaattatgtctgttcatggatgatatgatcttatatctagaaaactattccaccaaaacacttagatttgataagcaaatttagtaaagttttaggatacaaaattaatgtacagaaattagtagcattactatacatccataataatctagctgaggccccaatcaagaattcaatcccatttacaataccaaaaaaatacataggaatatatttaaccacggaggtgaataatttatgtaaagagaactacaaaacacaggggaaagaaatcatagatgatacaaccaaagggaaacacatcccatgctcatgggttggaagaatcagtattggtaaaatgaccatattgcccaaagcaacctatagattcagtgcaatccctatcaaattaggaacaccatttttcacagaattagaaaaatgaatcataacatttatatggaatcaaaaaagagctcaaataactaaagcaatcctaaggaaacagaacaaaggcttaggcatcacattgcctgacttcaaactatgctataatgctatagtaaccaaaacagcatggtactgatatgaaaataaacacacagatcaatggaacagaagagttcagaaataaagctgtatacttaaaaccaactgatatttgacaaagtctgcaaaaatatacactggggaaatgacatcctattccataaatggtgctgggaacattggatagccatatgtagatggatgaaactggactcatacctctcaccaaatacagcaattaactcaaaatggattagacttaaatgtaagaaccaaaaccataaaaactctggaagaaaacttggaaaaaactcttctggacattggcctagatacataatttatgaccaagtcctcaaaagcaaatgcaaaaaaaaaaccaaaaataaataaagaggacttaattaaactaaaaagcttcagcacagcaaaaggagcaatcaacagagtaaacagatatcctacagaaagggggaaaatatttgcaaagtctgcatctgaaaaagactaagttgcagattctataagaaactcaaacaaattaacaagaaaaacaaccccactaaaaagtgtcaaaggacatgaacagaaatttttttttttaatttaagaaaacttttagaaatttttcaaaaaaagacacacaagcagacaacaaacatattataaaattatcaacattactgatcatcagagaaatgcaaatttaaaccacaatgagatatcatcttaccttagttagaatggctgttattaaaaagtcaaaaactagcagatgttggcatggatgaggagaaaagggaacacttaaatgctcttggtcggtatgtaaattagtacaaaccctatggaaaacagtatggagagctctcaaagaactaaaaaagagctatcattcagtccagcaatccttcttctaggtttctacctaaaggaaaataaatcactgtatttaaaaaaacagctatactcatatgtttatcacagcactactctcaatattaaagacatgaaatcaacctaagtctcaatcaatggaggaatggatgaagaaaatgtggtatatatacaccatggaatactacttagccaaaaaaaagaaagaaactatgtcttttgcagcagtatggatagttggaactggaggccactatcctaagggaaataactgagaaacagagagtaaaaagttgcatgttttcacttataagtgggagctaaacaatgggtacacataaacatacagatgagtataacaggcactggggactccaaacatggggaggggtcagggagtaagagttgaaaaattacctattgggtacaatgttcactgtttgggtgatggtacactaagagcccagacttcaccacagggcaatatatgcatgtaagatacttgcacctgtatttcctaaatataaataaaattatgtaaagtacatgatgctttataatgataataaacaactgtcttactggtttatgtatttacaaagcaaaaagaatttcaaaagggcttgctttaaggaagttaaatcactgaataaactctctgcttttccttaaaattatatatatataaaatatattgtaatatatataatatataattatatatatacctctgatggatatacatgcaaaaatcctcaaaaaatactaggaaattgcatccaaaagcacaatcaatatacataaatgtcatatataatagataatgtcttatatatataaaatgtcttacacatgtttatgtaaaagcacgtgtatatatatatatatatatatatatataaatgtcttgtatgagagattggttgtcaagaataagcccatgattagatactttatatttatatttttataatcagtcagattgtttagtatattccataagcatgttacctaataaaacaaataatgtttttgttacaagaaaatacttatttcaaagaggttctcatcagtcctttgaccactggtttagttattgcaagacaatgggaagaatagcagttgtacttgtgaaaaaacaaaagtagcattatctgctgcatttttggttgatttccactagatggtagtattgaattcaagattcaacctgctatatattttaatgcagaaatttgataaattacagaagacatttgtattgtgttacttttaccgtctatgttaacatttgaaaccatattcagactatgtttatgcatgttggaatttttttaaaaaatacaacttctggaaatttgaaaacttcttaagaagctggtgcaatattagatatattgtattgtaattcatagaaataatcttttattatgaaactttttaaaataatttttgcatgtgttttaaattctgatcatagtcattttctttttcaggcaaaatgtagatttcgtttttagtctgtggaaagagtaagagaaaaataacatgaaaatatattttttttcaaatgtttctgtcaggaaagataggctcttggcaggtgtgtttgtgtgtaaaaatagactatcttcgagtacatattttcacttcaatttccatgaggcattataaacaaagacaaaaattaaaaaaaaaaacacttttgcaattaatgaatgatgagtacaatatgtagctaattgccctgattatgttagtgtgttattgcagaataataatgaactgaatgaacctgttttcctttgctgtattcctaaccagatgcacccctggaagatacattaggagttatctagtccatctccatcattgtactaatgaagaaactgaggactgtgactgctttttaaactgttctagagaaaaaaaggaaagatgggttccattgactctgttgaatactctcttactgatttacagatctttaccaagtacttgcttgcagagaatatccaaaagcaggaccagatcatgatactcttcaggacagtccctaatagttttcactagaaaggtatacagttaaaaagtagcgtaaaatggtattgacactggaaaatacaaaagtaccttgaattaaattgtatggtgaaaagcaccaaccgtggaatcaggtagaattaagtaatgaatttcagctctgtcacttacaatctgtgtaacgttgggcacatttctgcacctctctgccattaaatcttctcatttacaaaatggagttaaaaatacctaccacgtgaaattataggatatcctaaatggaataacttagtaagctctcaagaaatcgttctccccttgcctcattaagaaatcatttttaaaatgggaactacgttaaagcccaatttaaggcatagatcagcaatgtttgatggcatggatctgtctattttggggctaaattgtgttctgaccctccaaatgatcaattctaattaattccttggttgtagatttgtaaagcccgtttagttgattgcacagacgtggccagagtcaaggtacaggaacccacagactatagaaatcaacgataacatgtagaaaaatcacaggcaacagaaatgcactatttttagagattgtataactgctctagggtgaagctatcttgattggactcagcatagtgcaacagaacagaattacacaagatgcccctttccattacaccccattattcctctgtttttgaggatttatgctaacattgttctgttacagattgtaaacattgatgtattctgaaactgttaactgtaagcatttatgcttgcattgttttctgttcatttctcttgtattccagcagatgtcagtcattctctttaaataatctccatttattctcacctgcctatgaccagctgaagggaaatcacctttagttatgtcaaagtgacatgtttgttgaactgtaacaataataatgctccctattaacctatcagggacttgagccattttgcattcaaacaatgatgaatttttattttcttatttaattatttaaaaaatctccatctcagtttccaaaatgtgtaactagaaaataaatgagaagccagagaagacatgcagagaatttaaatttgcacttgtggtaaaataatctgcacttgcgtaggagaagacaaatcactccttgatgtcaatgtacggttatgattttactcatactttagaattttaaaatgtcatgtagtgtgatatatattcatgcagatgtgggtgaaacaatgtgctttttaatcattcctgctacaatcacaaacaatcattatgtctagccattgatcctagcacagggcttgtcaggtaagggcagattttataaaacctgggtaaaacaagcttaatttgcgtaaattgagtttttttctaaaagtgagagggtacctttttaaagaaaatgtagtaaatgcaaaagtcaatgaatccttggatgtttctcaaactatctttgtgttttaaatctactttctcattttaataggaattaatcatttatcctcaaggaatattttccttaaaagggaagaatattaccagtttttctcaacaaatctcgaattcattgtggggaaactgatgatgtctcttcatttgttttgtgattcttgtattttaaatcagttcattgaaacagcctggctgagtgctgtatttaagtatagaaatttctgctcatatctggtggctcttgctgaaggagggacatagagctagaatgcttgtcagggatcccaccttaacctgctcctgccccttagatagatcctcattgtctacaggccatttgcaaccaggcgaaataaaaattaccatgtttctctttattttatttattgaagatttttgactttgtatataatttacatagcttttaaatacaaaagctagttttaaggaatgtatattaaacagtggttatttgccaggacaaaagataccatactagagaaaagctaggaaaagaagaaacatagtttcatactaaacaactatttaataattttaagaaaaacagtacagtttaatatttgagaagggaaatatgctatcattctgaaaatcttgtatgcagaaaactcttagttttctaacctaatggtagtttctatactagatttaaaactttttgtactaggccttttcctcaaaaacttctgtaaaaccttaaatgttttattatcaatgcatatataggaatgcatatataggaatttacaaagtaaaagaagagagcaatactcatgtctgtcattgattcacacattgtcccctttagatgtgactgagagggtggtggctcacgcctgtaatcccaacactttgggaggctgaggcaggtggatcacctgaggtcaggagttccagaccagcctggccaacatggcaaaaccccttctctactaaaaatacaaaaaatagccaggcattgtggcagacgcctgtaatcccagctacttgggaggctgaggcaggagaatcgcttgaacctgggaggcagaagttgcagtgagtggagatcatgccactgcactccagcctgggcaacagagcaagactccatctcaaaaaaaaaaaaaaaaagaagaagtgactgagtactcagttatccagcttttagggcaaagtgatcaaatgataacagaaaggaagaggcaagagaaggattttacaaatacaaatagtaatgatggtccagggacatgatggaaatcgcaggatgaagcagagaagggagctctgtgtgttccctgggtggagattgtactaatgagctgctcacatttgagaaacacagattgatgagcttctctggcaattgttatgcagcaatattcccataagaagtcacagtagttatcacagtatcagagcaccgtaaaataaacacattgctttttccatgaacttgaatatttaatgttagagatgagtacaatggaggcaaataaatcctctcctcatttcctcacatccctacttttaaagattgtcaggtattcaatctctatcatagttgtttgagactttaggtccctatagtttatcattttccagtaatgtttttgaaatgcaataatttaaagatctctcgactcttggatttacattacaaatgctggtgatacaaaaatttcatttaaattagtctagaccatgaagtatggacttttagcatattatattgtaaatttgaaattgaaacactgtcatgatctttttttaaagaatttaaaactagtatttaaatattataagtttttctctgagaaatgttttacaattgtagtttatagttctgaggactgagagtgtaggagatttgcttaaaacaagaatggagatcagagctagggtgtctactatattcaacatttttcaaaattcgctctgccacctgtcaagagctgagctgagctggagagagctgagacgcccgtggtggagtggtcaattaagacaacaagccaaagtgaaagtaacagccaatcctttaatgactttctaaggtagtagaataggcaagaggaaaaagcttaaccattttaatgttccttttttctccacagaagggcactgggtgaaggtccaatgtatcagtgcacacgggggagtggggcggggaattatctcaccacctacgtacgggagcccgaacaaaaggctctggccattttatggacccaggggtggggatgggggtgagctggagaggggaggactaggtgtgggaaacagtgaatattgagtcagagagaaaaaagaggcttcaagtgtcctccccagtgaggaggcctccgcagaatgacccgatgaagagacctcctctctctgaatgcagggagggctagagatgcagatatgcataagcgcatggtgctgaggatggagtgactgagcccttgactgcagctcccttcagagactgcagtttactggctgcacacagtctggtgtggggaggacaatttttccctgtgaagcctgccaggtaaatcctttgcaattgtctgtggtagggtttgaaagatgattataggtttttggctaggagctggactcctcaccactgtctcatttcaggcctccatcacctcattttgggattattagaggtgcttttatccattctctccacttctctgaagtttttttccagcatgatccatcatgctcttgattgccagattgcttgcttctaaatcactagatcactaaatcactgtatcgttcctctactttggaatctagtatgtattatttttataccaaactcgagccactcaggtgagcatgtaaggcctttgtttgatgggcttcagtttatttatccatattttactacttcttacaaagttttctcagattttcctaagccaatgatgctcaatcaagcttgtacaacccaaggcccatggccacatgaggcccagggtggctttgaatgtggctcaacacaaatttgtaaactttcttaaaacattatgagatttttttgccgttttgttttttagatcatcagctatcgttagtgtattttatgttggcccaagacaatttttcttcttccagtgtagaatacagaaaccaaaagattggacccccgtgctctatatcttttgtacatgacagttccttctcagctccagcctttcatactgttcttagaacatctttgactgtcaactccacctatcaagctattctttttcttttcaaactcagctaaagatatcgtctctgtgcagccactgccctgcccctcacactgattctttttgctgttgttcttgctggttcatgaattcttcagccgctatttcattgcttttgtctgtcacactactaaaatataaatacttgttcaacaaacaacttcgaattattctctagttatttattttttcttaaaaaaagggttcaattgtatccccatctaatttttaggtattaatccttcttcatcaggtattatattctgcacttcctaggtggcaggcagaatacttggtattttcatttatgtcatataatttaattttcacaaaggctcgtgagtcatgcaatatttatcatgaggtatacaagataaaaatgaatctcagaaagttggagtaattttgtcatgcataaaagaccagtatactggcagttgtgagatctttcttgcgccaatgtccatgcttattttcttctacaagatgctgccattatactggaaacacaatagtgacagggtcaatgaatgagactcaatgctagtttatgtttatatgttctctacctcaagaaaaagtgtatctattcagcatcattagtaaagttattaactctaagtttttgttgttaaaaaaaattgattctggacgaaggtgttattagcattaaaggcagggagtcagagacacaggccttttatttggaatcttgagatttcatctaagaaatcttgcccttttgatgtgacctggttgagatgccacaacccttgagtgttggcctcctcatttggcagatgagattatcagattgctgatttctgaagtccatgttggcaatagtgggggttggattctatgcctttttttaattactgcactccgagtttgttttctacaatgtactcagttcttcctccccaatataaactgtatatagctacttcccatcatgatgtcctccttctgttagagacaactagaatatgacactttttctctgttttccatcatatggtttaaagtgccatgtctttgcctctgaatttgttttaaaaggagacattacagtattagtatctttatttaaagaaaatctaacctgagcatcattatttattggtcagtcttcaagtcatagctgtcataatgtattggagtcaaataaacaaatttccatctcttcaggtcctggacatatttttaaatatattaatgctattattaccattgttatttaaaatgtgttaaaacattatcttcatagcagatatcatacacaaatactcaagaacataccttcagtagaggtagaaattagaacaaagttatagccctctttccccagcccgacaagaaggggaaaaagaaatagaaatttaccaattatgttatgatgcaaggaatacaattctgtcctagaatgtgagttgtgtatgaacttcaaagtatgcactagtgaaagtcaaagccaaattagtgaattcattttattatatttcccactatttgttgaatgtatattttaaaacattgatttttttccgtgactgttttttagtcctgagaaagggaaatgatgcaggaggagatggtgagaaaagttaaaagaaacaatgggttgagtcacagtgcaaggctctgtttcatagattcccatgtacagcaaaaatgcttgtagagggagatgagagggaaaaaagcccaagctgatttcaaaaatactgtagtagccaagaagaacgtttgaattttaaaaagcaaaatgaatgtccacgtcattacatactgccccatttccttgaattatggccgtgtgaaattgatttctgtgtagattggattcactggcagtttcctttcctacaaagtcccacagttccctttcctttcctttcctttccttaaaaagcaaaggtacctcttggatttactataactcacaatgtccatcctaataacgggaaccagtctgacacggcgtttgatttgctgaacttaggtgggcttctgagacctccccactttcttctctgacgtgcacatttctgataagaaaggcagccactgctttaaaacaatgtagcctgagtttacactggcaggtggcttttcctcactgctttggaaacacagctgcacattctgtttacaagggttttccaccatcaagtctctgaaattttaatctggctaacaagcatttttactgatgataaagtgaaaacttccctctgctataaaatgaaaagaggctttcttcttgggaatctagattttgacaagcatatttctttttttctattgctaaccttctctcctttttgcatgtggatctcgttaggaaaaatcataacattggagacatttattttctgataaatatcgtaaccgtcatgctaaaaagtagaggtttttaaaaataatctcatgttagtcgtttgttggtgattacggagacttacaagcaaggctgcctatccacattggttaaatctaccatcaagaaggaaacagatgtacccaggcattttctcattaatatgttgatgctttcttactaaactccttaattctttctaggaaaagagagaaatgactgtggttttaaccataagcatatcatcgtttgcaaacctgccactaaccttagcaggatctggagcaaaagtacaaatgtaaaccccataatatttggctaaatatctagcaattataaatcaagctaacagaaagtttaaaaaatctgtcctattttcctatcttaacacatttcttttcatgatgacttggaagtataggtctgaattcaaacttcctggaccattccaagtcctgagctgggatgtgctggtagacttggagctggcttcaggcatatgacttgacattttcctttcccaccctcagctctgcccctcgccatgagaagccccacatgcacaggtgtggacgcccagcctggatgcatttctttctttattatttatttatttatttatttttttgagatggagtctcactctatcacccaggctggagtgcaatggcacgatctcagctcaccacagcctctgcctcctgggttcaagcgattctcttgcttcaccctcctgagtagctgggattataggcatgcggcaccacacctggctaattttgtatttttagtagagaaagggtttctctatgttggtcaggctggtcttgaacttccgaccttaggtgatccacccgccttggcctcccaaagtgctggaactataggcatgagccaccgtgcctggccgcctagatgcgtttctaagctccatccatacctccctcattcaacaaacggtggctgcttggccacccctagggcctaagagtgcagacacctacgcatactcacctttggagggaagagtccaaaacaatcctggaaacaggcttagagctatgtgggcagggagttgggggactggtatatcgatagcaaagtcttgaagggttagtgtgggctccatgtggggaggggataatgtctccttggtcatatgagctcctcagttcttgtgaagacatggccagggaaacacagggcccaggacagggtactagttacttgaatccttgttacttgtatcacagtctgtgttgagaatagttgggaatatacaaaaacaaagtaacagtcataaggtaagggtgctgcttaaattacctttaatttgggaatctaaatgaaatagacataataaatggctacacaaatgatgttatttaggagcaagatatcctgtcccaaatatcaattccatctgcaggccatattcagatttcaaattaattactgcttttgaggctctggcaaacaaagtagagaatttttttagatattgcctctatatccttaataacaagttaattcttcctcagcacacaattatggggcatctgtattgtaccaggcatcatgctgggtgctgggcagttcaccaaagagataaaagagaacagatcccattctcaaggtgctccatatttaaggacataatttgatggcttatggtaagtgctaataaagaaacatttaagacactttggtatctgaaagaattgaacaaatttctggatgcaggataatgcaatggttaagtggatgggcttcgtattcagagatctctgtttaattcccaattctaccacttactagtttcagttacttaatcataagccttaatttattttatctgggaagcagattgtattgagaaaacacatatgttagtgtaggccttactatgtgcaagctctttggatgtaatgacaacaacatcatgaggaactattattagctccactgtacggagggaactgaaagcacagggagattacttaaagtactgaaagtaccttactcatagggaataatggaactaagatgacaacccaagtagtttgactccagcatctctaattttaaccactattctttacttccttctaaggaaaagtacatttcctgacacctagtaagagcacattacaccattattataactattgttagtgactataccttgataaaggcaaggcaagcaggtaaggaaaggcttcacatcagcagtaattaagttgtgcttgaaggaggcatgggaagaccaagccatttcaggcagaagaagctatatataaaggtcaaaagagaaggtgatattgacgggatactgggactagagtggatattaggaagtcgtggcaaatggggccaaaccctggagggccatatataccaaactaaggaatctggtatttatttattgggtaaaggatgaaagagtgggtagatggccaaattttaacgaagagaatattgttaggtgactttctactaatctgataatttgtcattaataaaggaagataactttaatgatctgcaactcatgaatatgggaaccagttaattctaaagactgagagtggtgtttgcagcctagaaaccaccttccacgtgtggggaaacaaaaaaaggcttcagctgataggctgattgcatcttctttgatccagtaactatgaagaaaatgtaccttgcatttgctgctatagaattatctccttaacgcaaagcttcttcgctttggaacccccacactcaaatgttattgaaaggatgaactgctatgtttgtttctgtttggacttttatcttttcccattttgaaatacattaaaaatacattccgtataacatttaaatggacttgctgtaggtgcaggttcttaagaatgcaattctttttatttatttatttatttatttgtttgtttgtttatgtatttatttttttattatacttttagggtacatgtgtacattgtgcaggttagttacatatgtatacatgtgccatgctggtgtgctgcacccactaactcgtcatctagcattaggtatatctcccaatgctatccctccccgctccacaacagtccccagagtgtgatattccccttcctgtgtccatgtgatctcattgttcaattcccaactatgagtgagaatatgcggtgtttggttttttgttcttgcgatagtttactgagaatgatgatttccaatttcattcttgatataacatcgtcaaatatttttgagggtactataagtgcaagttagtgtactaagtattgaggggggaagatataaagataaaaggctaagttaattagccatgtcatgtaattatgcaatttttacaattcaaatgagtcctgtgtactctgtccttattttctgcttagctctgactcattcttattttaatgatcctgaaaaatagcttcccagtctttccaaatatctattacctcccccatctcccatgtctaatgtaaagctaaattgtttatttaacaattgtgactgaattcaatggatttgtataactgtgtaaagctggtccaactatttccctaggggcatgtatcacaacatgaactttttggcagagtctgtgtagtgctactgtttttcaagaccgtgttttgatttttagaatactctagttcaaaattgaactgaaaggttccaaattggaagtcaaaatttatgtgcttcaaatagtaaacatatgtaactctaatatgtatgaacactatgtgtttgcatgtgtgacagtgatagtgagagaaaaatactggagagaaaattttggagagaaaatgattggttcagcgattttgactgaattggcttataaaaccaattcactccctctctcaccaaagaatgagtgagtttttgagactcagttcctgtctctcatcttctttgacacctcccctgaatgcttatcttacggtcctaccattttatattgagtcagtaaacagcaatgactgattattcttcataaagtccattatttctttgaattaattttattggctaattattatagtgtgcatagttacagtatatttgtgtattttatactaaaagtaaagacaatgaaagccctattataagcatcctacacatctatattctggtatagggatacccaacccctgggccagggaccagtccacggcctattaggaactgggccacagagcaggaggtgagtggcaggtgagcgagggaagcttcatctgtatttacacctgctctccactgcttgcattcccacctgagctccgcctcctgtcagattggcactggcgttagattttcataggcatgcacaccctattgtgacctgcgcatgcgaaggatctaggttgtatgccccttacgagaatctaatgcctgatgatctgtcattgtctcccatcacccccagatgggaccgtctagttgctggaaaacaaacccaggccttctactgattcgacattgtggtgagctatataattatttcattatatattataatgtaataataatataaataaagtgcacaataaatgtaacgcgcttgaatcatctcgaaaccatccgccatcactggtctatggaaaaattatctaccatgaaactggcccctggtgtcaaaaaggttgcggaccactgttctggtataccttacagtcaaataatacttttctgggttggttaaatttaaaaagaagtgtggtgtttgatgaagaagaaagacgtttcatttagctaaataatatgatgaaacgtagatttgatcacacaaaacattacggctcattcaagagttacttgtgtgcatatttgaaataatgggttacaatttttaggttaaataaagaatggagaccagagactgatctcctgagagaacaggaaagcattaaagagcttaaggtcaggagagatttaagagcaattttagtgggaataaggggtgccagaattataaggagataaggttttttgtaaagtaagtaatttcagaatacagtgttttagaaggagatgctgaagatgacatgttatcctatgtagcatctgagtggcatggatatgatgggaaccagtgtagaggaatgtggcaccgagacctgcctggggtctgcacatgaatgtagaaatcactgagaagaatcctaagaaaggaaaaaaaaaaatacaccagagtctcagcccacaggaaatctagtagagcttcagtgaaggcgtattgatccaacgtcctgaaacaagtctgaaaatgggatagagtataaggaaaagcactgagagtttggaggatgtgggtgaatttgtaacttctttctgagagaatttggaaaggagagaagggtcaatagggaaaagctgtgttttacacaactgaattggtaaagggtatgtctgcttttttttttttttgagactgagtctcactctgtcgcccaggctggagtgcagtggtgcaatcttggctcactgccacctccgcctcccgggttcaagcaattctcctgcctcagcctccctggtacttgggactacaggcccgcaccaccacacccagctaatttttgtatttttagtagagatgaggtttcaccatattggccaggatggtctcaaactcctgacctcatgatctgtccacctcggcctcccaaagtgctgggattgcaagcgtgagccactgctcctggctgggtatgtgttttaatagatgaaagtttggaaaatgaaagatttggccgggcatggtggctcatgcctgtaatcccagcactttgggaggccgaggcaggcagatcacctgaggtcaggagtttgagaccagcctggccaacatgatgaaactgcgtctctactaaaaatacaaaaaattagccaggtgtggtggctggtgtctgtaatcccagctacttgggaaactgaggcagagtaatcggttcaactcgggaggtggaggttgcagtgagccaagattgccccactgcactccagcctgggggcagagtgagaccctgtcttaaaaaaaaaaaaaaaaaaagaaaatgaagaaagtgaaggatttttccttgatagtttaacagggttaggaaagtagagaagaaatggctaaaaaatagaagcaggtcaggtagaagtggcttaaggaagaattggattggctttcaatgaaagccataattttttacattggttggtgagtgactcaagacccagcaataagggaaaaagaaaatgatgaggggtaaagtggaggaaggctgtaaccacagggaagtggctgggtgaagaatcaacctatacatcatttcagttgggagaaattttgctggagaaacacagaacacattagcctttgctaccatgaggtctcataccaaagcaaagagctaacattgccgagatactatgtacttgattttgtgctagctctttgcattcagtattttattaaatcttcttcagaaacattattatccatattattaagatgaggactctatttcttaaaagtgaagtgacttgcccaaaattatgagtagtaaattctggaatttgtacataggttggtctcactccggagtcccaacactatattactatagtacgtatgctgtcaattctaagatggcattaatggggataaatatcatcatgtcactctgctccttataatcctttattagatttctattgcctgttggatacaattcaacttgttcttcgttacgtaatgcccatcaggattgggacttgcctacctgcaaagattcatttccatagctccaccttcccattgaatctcagctacacatagtctacctgctgttgaaagtgccaaagggcctccttgcctgtgtacactatgtcttcctttctcttctgcaatatttctctccctgcatcttgcccttttccagccactccctctcccaccaaacagtgagtgagtttttttgagactcagttccactctctcaccttctttgacacattctctgaaagcttatctaacagtcctactgctttatattcattcattcaacaaatatttatcagattcctactgaggatataatagttaatgagaaaagaaccttgatcatgcaaatctggcaagtagtgaactcgatgtaaaatattacctataatctaacaagatttcctgtagaattgagcatggtaataggacacaaagctatgatgtagggtcggggatgggacaagaagaagggaggtattttaaataggaaggtcaaaaaagttttctccaatgagatcacgttgattaaagacctttagtgaagaggggaagtgagctatgaggagacctggaaagagaatattccagacaaatgagaacagaaaaatcaaaagccctgaggaggaaacaagtttgatgtattggaagagaggaagaagatccatgctgccaagaagaggggtgggaaagataggcagaggctgggtcctgtgggactgtagatctcaaccctagctgcatgtctaaattacccagagagcttaagaaaccactgatgctgagacagaccccgcctaagcaatacaagtttaactgaaggggcccttgctgggcagtttttaaaacacttctcagtaagaaatatttctgttattgaaagacaccatcagggggttccttcttcaggtttcaggatactttacaaagaagtaataagtaagaggaaatatctctattttttatgaagcccttctgggttctcaattatgaattttaagttcaactttacaactatcacatgaatacattctcactgttaaaaaaattagaaaaaaaatatagatatatccaaaggcctccttaactatctgtaatccttcacacagctaacaatggttattagttggacatttatcgtttttgtcactttttatgcgatacacgtgtttattcttctgctgcaacttgctttaagaaaacctgctgagaatggagtgaacccgggaggcggagcttgcagtgagccgagatggcgcccctgcactccagcctgggcgacagagcgagactccgtctcaacaacaaaaaaaaaaaaaaaaaaaaaagaaagaaaacctgctaacagtctttgacatatttcagtgttggtacacttcagaaataagaatttcaggggcacagaagatgttcatttaagattttaatagatattgtcaagccaccttcaattgagtgtaccaaattatgttcctgccagcattgtaagttaatactagtttccccacaccctagtagatactagattttattgtatctgaaaatgtgtcactatgatatataaaagagcattcaattttattattggttaattttcactttcccaactttagaatatgtcctcttctgtgaattgcccatttacatactttgccctcttatgtttatctttttttgttttatttgtaccatttctttacatattctaaatttaatttttagcagttacatacattgcaaatattttcttccagtccatcatttgccctttaacttatggagacttttgtcatacaagatcagttataatgtcacattgaggccaagtcctaagcccaggtagagaaaggtacagagagctgtttgtgggtgtctgatagattatagtgttaaggaaagtacatatcaggaaaagtagatacaatagaattataatttgtaaagtaaaatttgttccttgttcaataaagattaagcctctcaaatttttgaaaactccttggcatctgcatatattagagcacacctcaaagacaaggaaattcagctgttaagcttaggcaactatagaagattttaaaaggttttaacacttcctaaatgatatcataaaggaagatgtaattgatgaatgctgagtatttacctaaatttgttgaactggattatgagaatcagaaattattttcatcctgtgcttcagagagtcttaattctataaaaataccattttcatcattgagagacttccaactacgatgcctttgtaaaccaaacagattgcaaagtggtaaagttctacaaacagttaaaatactgtaagtgttatgaaacaaaagttctgaattcaacaagctgtgaaatactatattcaaagctgtagcctgtgacatccaattggggaggtgacttaaaatagtgtggttaggaaaggtagctgcagtgttaaccaatgtatttctttgtttacagtattttatttctccatttagcccttccccattgaatacattgagtacagtgaaagtataaacaacaggattaaattactgacttttatacttcagaagtctggctctcaggggctgaaataacagatgtgggagaattctaataaataacagtaaaattcacaaaacatctcctcccatcccagactagaaagaatcctctaaatctgagaggacgagagcaggaaggaatgtaatgaaaggattgtcagcgggctttgaaacgagcctagtgaaccaggagggactgtacagaatagagtgacaactaggatcttcccgcctccaccacaagcaccagccattgtcagggccccacagcagcctagaagcccaggcaggtccctgctgcctatgtttggtgagcaccaccccacaccctggtatgctgtggtgaaaggacagcactattaaaagagggcataatcctatctacatggcaataaccattactaacatctttgtgttttctatccacctatcattccatcttggcagcagatacagatttcaacagtatataagaaaatgggtgaaatattgccatagctctgttaaggagtaaatttatcacaagcgttcataaatacgaacaaaaataattaagctaagcatttaaatcaaatattttaaataaacaaaaaagagcaaatctgaggaaagcaaggggaagaaaacattaaagaaaaaaacaaataaaaaaattaaaaagatttttcagagcagaatttataagtcaatctaagatcaggctcttcgaaaatgccaatcaaggatatctaattaagaaggaagttcttgaaaaagtaaataagaaatatctaaaaagaaacaaaaaggagaaaaacctgaaataaaaaaaatggaaaataagggtaacataaagttgaatgtaatccatttgaaaaccttgattcaacagttaattttagagaaaaaacaaattatcatgattgactaaagacaaaggaaaaatttaagtaaaatgataatcattaaagaaattggacaatttagggaggggaaatgcacttaaaatggctctatggctagtgtatttaagctaaattatttccgaatttaaggaaacaaacaacttccatactatactatataatattcactttaaagtctattattctctctattcctatatcatgtaaaaattgaaggtagagattttgttgtttaaatattacataaatatctagttttaattgtatttgatgatcaagtctaggttagctctaaatttgagactttatttactccgtgttttgtgatgtaataatgtctttaataacattagtgaaagcacccactggcactaacaaagcttttttttgagacggagtcttgctctgccgcccaggctggagtgcagtggcatgaacttggctcactgcaacctccgcctcccgggttcaagccattctgtgcctcagcctcctgagtagctgggattacaggagtgcaccaccatgcctggctaatgtttgtatttttagtagagacggggtttcaccatcttggccaagctgatctcgaactcctgaccttgtgattcacctgccttggcctcccaaagtgctgggattacaggcgtgagccaccacgcccagcactagcaaagctttctattggaaaagcagatagagctacttttcttttcctcattgtaaattccaagtcaatttttgttccttctctttcaaaactaccgttcctttgacattaatgtgattaatctttagcatccactatcttgctatcttccagatgtgactcttcttgtaaacaggcttgtcttttgaagaaattaagaaggaaaaataatcttttatatttgcttacttatttaccatttcgtgtgatcttcattcctttatcatctagacccaaattttcatctggtaccatctcccttcagcctgaaaaacatcttttggcataccttgtagggcaggtaggctggcaacaaattctcttgacttttgtttatttgtaaatgcattttatttcaccatggatatgaaggtagttttgctttgctctcagttctgtgggaccaccatgctctttttgctctttaatctgtgcattatgattgggaaattgtccccaggcaaatagtagaggtaattgtgggacctatctgatggatttctcttctctcagaaatttcagttttgcatgcctcttgttcaatgactgaacacagttgcctcatatatttggtctggcttcaaaattccttatggcaggagggctagtctagcatgtgttactccatcatgcctggaagtggaaagcctctaacactgccttttataactttgtaaatctttttttaatatatcttcttatacgtaattataaatttttgataactttatactcttttatacctttagtatctggctctcccttttgttttccccaccaacttctcctgtcatcattcctggtatcttcaacatacatacatattatttatcctagcttcttagtaccttgatctcttcaactctaacaattttctcctctacaccagctcagtgactcaatcacagacattatcaacaccaacaactgtgccacctccaaactctcagttttaaacatttcattacctgtctgttaattgctatgcttccccattcatttttttttcatctattctttttttttttcttttgagatggagtttcactcttgttgcccaggctggagtgcaatggtgcaccattagtagagacggggtttctccatgttggtcaggctggtctcgaactcccaacctcaggagatccacctgtctcagcctcccaaagtgctgggattacaggcatgagccaccgtgcccggccccatttattctgatatcctacgctgtctattcttcagccctataggagtctccaattttttgttccaaccactgttttactgtatttcatttccatgatggtatcaccctgctccttacatgcttagcttccatagctcagtacttaactcattcctacctgtccctttctgcattgttcttgttgccaaactacctggtcaaagatttgtctgtgctgctccagcattgaagtcactcatcttctcctagccttccccttctttgctctgctttcacactgacctccacattgctccttgaccataccagacttatttctacctcagggcctttgcactggctttgccctcttctgggagtgcacttcccaactatctatgtggttttctcacctgcaagtctctgctcacgtcacatcttttttttttttttttttgagacagagtcttgctctgtctccaggctggagtgcagtggcgccatcttggcttactgcaacctctgcctcctgggctcaagcgattctccttcctcagcctcccaagtagctgggattacagcacacaccactatacccagataatttttgtatttttagtagagacggggtttcaccatgttggccaggatggtctcgatctcctgacctcgtgatccgcccacctcggtcacatcacatcttctaagtgaggcttgagctgctcaccttactcatagttatattcgttatctccaacccgaaacccttttttccttattacttaaacacttgttacatatgtattgtttacttatttattttgcctgtttttttccttttcccactgtaatgaaaactccataagaacaaggaatattttcggttttctttactgctttatttacagtgcctgaaacataggagaagattatcagtagttatgtgttgagtgaagggatggaagggaattatacatctgcatgcccacatcttaatttaaatatgtgaacaaaaatttcaaataagcacccaacaaggccattatatttatctattaaattaactttcctgctctctgagacaattatttgacaacttctttagtttccctctcacattccattacttttatcctctttccccattttaaactaaggacttagtttcatgcttacttaaaaaataaatacgatttaaaactcttatcttcccattactaaacccaccaacatacatttgtcctttccctcatgctctgccttccttcttggtacaattggtatttatattaaattctccttttacattctgcatcccattccttcttggcttatatggactttgttcctatactcattccctttctaattgacagcattgatttctctgtctctaatgaatcatttccattagcatgttaacattcctcaagtacactcaccaaaaaaaccaatactaaaaatagttcttccccaaatccttttgtttttaggtcaatgctttaaaggagttatttatatttatctctacttctcctcttttcctttctcatctcacttcaacccattactcttggacaattgatcttaccactctggagaaatggtttatattaaggtcaccaatgaccaccatcttggaaatctttattaatttgactcttattttcatcttaccagccttttcagaagtttttgaaacaattgttctccgctctcctacttgaaattctttgcttcttccatgactctttttacttttttttttttaaattcatgcaatactcctttttggattctttagctggtatctctgcttctgttggatttctaaatgctagagtgtcctaggactctgtccttcacttccttctattctctgaactcttatgaacaatgttactgtaaatatttctggacacatttggttacaaatttatgtaacgttctctaaggagtggaatcattgccagttagggcatgtacatcttcaattttgctagagaaaaattgtttgccaaagtgtttgtaccaatctaaacattcacttcagcttatgagtttctattgctttacctccttgtcagtatttagtattttcaggcttttaaatttggccaatctgtgattgtaaaatatctcagattttaatttgcatgttttaattattaatgagtttgtccatctcttttcatattttctttttatttgagatggagtctctgtcacccaggctggagtgcagtggcacgatctcagctcactgcaaactccgcctcctgggttcaagcgattgtcttgcctcagcttcccaagtagcttgagttacaggcgcccaccaccacgcccagctaatttttgtatttttagtaaagacagggtttcaccatgctggccaggctgaggctggtctcgagctactgacctcaggtgatccaccctcctcggcttcccaaagtgcttggattataggcatgagccactgcacccagcctcttttcatattttcggcgccagtttatatttatcacttccaaattcatcataattgcaattttaataaatatttcaactataatacatcttctgaaataattgatgaacacatcatattggaccacagtaaacactgatttccattacataaactacaggcatatctcatttcattgtgctttgctttattgcctttcacaatatactttttacaaattgaaggcttgtggcaaccttgcgtgaagccaagtctatcggtgccatttttccaacagcatgtgctcactttgtgtctctgtgtcacatttgatgattcattattattatatctgctatggtcatctgtgatcagtgatctttgttgttactaatgtaattgttttgcgtgccatgaaccacacttacataaaatgatgaacttaatccacaaatgttatgtgtgttctgactgctccattgaccacccattccccagtctctctttgggccttctctgaaaaacaatattgaacataagccagctaataaccctacattggcctctaagtgttcaaatgaaaggaagagtcacaccactctcactttaaatctaaagctagaaataattaatcttagaaaggcaggtccaaagccaaaagaggctgaaaggtagacctcttgtgcaaaacagatagccaagttatgaatgcaaaggaaaagttattgaagaaaatagaaagtgctactccagtgaagccatgaatgataagaaagtgaaaccactttattactgacatggaaaataatttagtggtctggatagaatatcaaaccagccaccacatttccttaagtcagagcctaatccagagcaaggccctaactctgttcaattctgtgaagcctgggagaggtgaggaagctgcggaagaaaagtgtgaagctaacagaggttggttcttgaagtttaagaagccattgccataacataacagtgtaatgtgaagaggcaagtgctgatggcaagttatccagaagatctagctaagagatttgatgaatgtggccatgtgaaacaactgattttcagtgtaggacaacaggcttctattggaagaagatgccatctagggccttcatagctagagaggaaaagtcaatgtctgccttcaaattttcaaaggctaggctgactcttgttaggggcctagttaggggcttttgttaacttgaagttaaagccactgctcctttaccattccaaaaatcctagagaccttgagaatcatgctaaagaatcacgctaaataaactgccagtgctctaggaatggaacagcaaagcctgggtgacaacacatttactacagcatgattgactgaatattttgagcccactgctgagacctactgctcagaataaaagactcctttcaaaatatattcattgacaatgcacctgatcacccaagagctctgaaggagatatacgagattaatgttgttttcatgtctgctaacaacattcattctgcagccctatggatcaaggagtaattttgactttcaggtcttcttatttaagagatatatttcacaaaactatagcagccatagataattattcctctgatggatcttagtaaagtaaatcgaaaatcttctgtaaaggattcaccattctacatgtcattaagaacattcatgattcatgggaggaggtcaaaatatcaacattaacaggagtttggaagatgttgtttccaaccctcatggatgactttgaggactttaagacttcaagggaggaagtaactgcagatgtgatggaaatagcaagagaactagaattagaagtagaacccgaagaagtgactgaattgctgcaatctcaattgctgcttgtggatgaacaaaggaagtggtttcttaagatggaatttactcctggtgaaaatgctgtgaaaattgttgaaatgacaacaaaggatttagaatattacatatacttagttaatgaagcagcagcaagggttaacaggatggcctccacttttgaagaagttctactgtgggtaaaatgctatcaaacagcattacatgccacaagaaaaatcttctgtgaaaagatgagtcagttgatgcagcaacctttattgtcttattttaagaaattgccacaaccaccccagccttcagcaactatcacagtagttagtcaggagccatcaacttcaaggtaagactctccatcagcaaaaagatttggacccactgaaggctcacatgtccattagcaatttttaggaagaacatttttaaaaattaagttatgtacattttttagacataatgctatttcatacttagtcgatgacaatatagtgtaaacacaacttttatatgcactgggaaaccaaaaaatttgtgtgactcactttattgcagtgatctggaactgaacccacaatatctctgaggtatgcttgaatatcttttcattaaagttcttattaatctcataatgttatctccattatggtaaattaataattgatatgcttaattatatactatatttttatctatagtctataattccccacttggctacaacagaaatgagcaaactttttctgtaaaggaacaaagataaatattttggtctctgttgcaactagggataaactctagtgttgtagcacaaaagtagacacagatgatacataaataaatgaagcagggagcattctactaaaactttattttcaaaaacagtggcagctggatttagtttaccaacccagggtctacaaaattagaatgattaatctttatcaaatgccctacttaaattcagatatagtatatctacagaactttcttaatcaacttcataatctattaatctgtcaaaatcagaaatgattgatttgacacacctctttttagtgaaactgttgagtcttggttatcatcacttctttaaagtatttctgttttaccctttatcactcattttgtgaagtgatcaagatccatgtcaatttgatagtacatagtttacagacattaactcctcccttgcgccctcacttttgggcaattgaaactacatattttaacttctatctttccttggtatttttcttgattcctcaaagagcactagttgtttcatgaacatattaggaactaattaattagaatgagaaggcttgataattttaacatctaagttgtataatactatctcatgtactttggatttcagttagtattttttctaacttttaatataacattttcagatatacctaatacttgtattccatggttattaataatttgctatatttgatttatctttttatctgtttgttgatgtatgtatttttgcctgaaccatttgaaagttgaaatctcatgactcttcacaccaatgattttctccctaatgaaattataattgttacagttaagaacattaattttaatatgacctaacatatagctcattttcaaaaatatcaaattaatttaaaaatgttttaaattttattttttattatggtaaaatatacataacacttacaattttaaccattttaaagtacgcaatttagtggtattaagtacatttacactattactcaatcaccactactattttcagaactttttcatcgttccaaacagaaactctataccacttaagtaataagttaccacttctccctccccagagctcctggtatcctctacaagttgagcatctctaatttgaaaatctaaaatctgaaatgctccaaaatccaaaattttttgagctctgacatgatgccacaagtggaaaattccacatctgaccttatgtacaccaacgttgcttcatgcatacaattattaaaaatattgtataaaattaccttctgtgtctgtaagatgcatatgaaacataaataaatgttgtgtttattttgggtcccatccccaagatatctcattatatacatgcaaatattacaaaatccaaaatgatttgaaattcaaagcacttctattcccaagcatttcagataaggtatacgcaaactgtattctacttcctgtctctatgaatttgcctgttttaggcatctcctataagggaaatcatgcaacatttgtccttttgtgtttgtcttattttacttagcatactttttcaaggttctttcagttacatatcagatgtatgtatgtcttccagtatgtatcagaactattctttttatgactgaatgtgtgtgtgcgtatatgcgtgtgtgtagacacacacacatgcacagatgcatatgtcatattttgtttatctgcctgctcaaatctgctgttgaatcctctggtgccccggtgaacttttctcttaagttattgttcttttcagctccagaattattgatttgtttctttatagaatttatagctctttattgatttttttttaaaagaaatgaggtcttgctatgttgcccaggctgctctcaaactcctgggttccaatattctcattttgtttgttttcctgaattcttttagttctttgtcaatggcttcttttagctcattgaacatattcaaaacagttgatttaatatctttggctagtaattcaaatatccaggcttcttcagggatggctcctgtcaaattctttttcctatgagtaggctatcctttcctgtttctttgtatattttagttttttttattgagaacctgacattcttagtattataatgtggtgactctggaaatctgactctcccacttctcagggattgctgatttttgctttttgagggctacagccatccatctgagacatttccacactatttttgcaaagtatctattctttgttgtgtgtggttactgaaatttctgttccattatctccgcagtcattcagtgacctgataaagatttctttaaaatgtctgccttcaaagaaagggggaaaacattctgtgctttaactttttcagtggaatctctttgctactgaaaggactgaaaccaaggcaagcacgtatgcctgtctctcggtgcactgccagaccaaccaatcacattacataaaatttttggagaccaaagtctccactgcccacctggtaccagacatctgcttcaagaacacgggctgcaacccccgcagctgtaatggggctgaagaatggggcaggtgatcattgttttgcatatgtagctcacttagaaaatgtagcagcctctccctttatcaagcactcccctggttgccatacatgtccaattaggttttagtgttccaaattaattgatttcaattgccctttccagcttaacagtttctttggtagagagtatgaccctagagcttcctattctgccttcttgcatttcaccctagtactttctgttaattgaaaattaggtctaaaactttaattagattcaggttaaacatttttgacaggaataccttatattgaacatatcattagacacataatatcaggatgtcccacaatactaaaatcagtctctttgttaaggcctgaatactagatctcttaaatataaaggtagttttcccctttgggttagtgaataacctgtgtcaacccttggaaatttgcaaatatcctgttttccaacatctctcaacctaatggttttagcgtgtatgcttgaataaattaatttttttgttattttcagtctgaatatcattatcaaagtgagagaacaggcgaataaaataaaaatctagtgtagtgtttttaatttcttcccaccgtctgttaacattcaaatatccatctcaaatggggcctttccctttcttgtttctttgtttggtttttccttagtgtttattagtaagccctcggctgacttatggatttcaccttcatgattcatccaagccagcatcttacatctgtccttggctgtgtgctcattcttcctgctgttgtacacatctattaccatctaaattcactgagaacactctgtggaactcatttatttcttaatttgcccttcatttttctacctcgttggaataattagttattgcctagataattacatttttagagctttcaaactctcttaatccatctttgttaagagagatccagaaaatagaatgaaatccttgcctttgtatttaaagtctgtctcaaagaattatacaaaggaagttttctccatttctagtattacttactcattttttttctgacaatagtttttttcattgccaatgtattcctccctgttgattggaattaattctggtgtgacagtctttttccctgcttctaatttcagatcagtgaaaatatcggcaaggtcaaaacttgacaggtgttctactttaagctaatgagttttgttagctctttgaagggatgaagtttcccatccctgctatatattaattctgtgtcagctttatcatctgcttctcccttcttttagctttacccaaatgaactctaatattttgctttctcacataacttcattactttctaatggatgtataattacacccactaacttcccactcaccatacctgtttttttaaattgaagttctacactcttaaaaaccaaaatatatcttttaaattaaaatttggggttgttacaggtatatcaaaatagtgaagagatatttcttatatatttctgatgaaatactgttaacgccatagtctgattggagagcaaatttgagtccctctctctctctctctgtgtgtgtgtgtgtgtgtgtgtgtgtgttagagagaaaaagctcattaaaatggttaatattctttccttccagaattgatccaacacaaatgatgagcgatagatgcctactgatgtaaatatgtttctctcttcagtgtcatttataataatgaaattaaacttcagtagtttatgataagagaattgattatgtctgttgtagtaggaccaaattatgacataccataataattaaaatgatttatttccaagttattttgccttaacaaaacaacttatggcatcatgttaaataaagacaggagcgtctaaaagacatccaaaatgatttcagttctaacttttaactaggttacctaccccaggaggtaggctgcacaggagaaactttttctcctattccctaacgtatagagtatacttttttctgagcagtccatttcctgcttttccctcacatttcaacctagctctgtgtgtaattctggaaatgaaggctgcagtactgcaggaacatccagactgactttattgttctaaagcgggcaagggaaataaggtatcaggaagtagaggcaatgttgaccctcttctgacattattgtgtgtctttgatgaccataatgcataccatggcttttcccagagaaaggccaccaaatgtgtcagaggagagaattttttgggccatcttaaggtacagagttgtatagctaggatacagtgtatttttccattttaactatagatttactcccattgctgcagctgtcgggagctatccacagggttccatgtgtctgaatctgctattgacatgacagcaactctctctgcagggcctcatatgattagtaggacagatgaagaattccacagattttccttactcctggtgacatctcctgtctgccagccgtggcactgccctagatatcactggagagacatagactctcagttcctcgatcttcaacaatctgtttctccgtcatttctcagtcacccacacacatggtcacagcacagaatttgttattaccaacatctttatcacctgtcttaatctctactacaagtatcccattctatgaaaactgtatcttatctttcctatttatttcctctaaatgtctaagacacaaacaactcagtctcatatgcatctccaattcactgactctaccacctctataatgctctcccagaaaaccctcaatgctttcttaaatcttcctgtagcttggacctaggaatctgactgtggttggaagaaagtacacaatcatgactgctttaaaaaatatatgaattgtgactaatcttaagtcaactcgatattgccaggaaaaatattacatttccttaattctctgttcccttattatgttaggccgttagtccataacttatctttccaaaacttccccaattagtctctactgatgaccttgctccctatttttctgaggaatttgaagcaatcagaagagatctttcacatgttctcaccaccacatctgccaatctatctctatcagcaccttatcatcttctttcttattaccatgattgaactgtctgtcggcttggccaactccacccttcttatgcattgtgtcccatctctatcatctgctctagaatcgctttctttaaatttctccctatcattcctgcattaacattttttgctatacaacaacattagaattgcttccatcttaaaattaccctctgatgataccaagagcccttatacttactgccccaattctctgatctctttgcagcaatctcctcaagagtgttaactatacccaggctatccacttcctttactcctctttcctcttggagcagccccaataaagttcttgtcttgatcactgcactgaaacagctcataatagtttaagagttgcatttgcatgaccagctccctggtcaatattttcatttttgttgtcatgtaccgcagcctacaagcagcatttgacatagtgcgtgcgctttttaaaacattttctttacctggcttccagaacacttctttctctgtcctcctactgctccttgaattcctcttttcagtctcttttgctcttctcctcaccttcccaacatttgtggaaaccacaggaggtaacccttgtatctcttctctagcttcccctacttcctaggtggactcatcatttaatggccaagttgatacttccagcctctgctgaactcagaccttacacatccaagttcttagttgacatccatctggatatttaataagctttgtaaatttaacatgtcccaaacaagctcagtctgcacacacacccccacttacatcaatctgatacactcaccctctcgacatcttattgaaaggcccattcatcctctagtttctcaggtaaaaattctcagagttatctttgactcctctcactcttcacaggaaaacatccgtaaactctgatagcttttcctttgacatatgtctagaagagtctgaccaccacttattacactactgtgactctttcccaactcacatgttcttacttggacttttgctattgtttcttattatctttgcttctcatcttgctccctaacagaaaattcttcacacataacagagataaaaataacattaggttgacatatgtaaatacttataaggattttctagcaatttaaatgtactgtgattataggtaaacttgaagaggatgcagttaaagatattttagtatgaagcatgttaacgtgctttaaaggactggccctacaaaaccttatacattttttaaaagaaataatttatttaactaggccaaagttattttccaagaaactgtaaatgattggcttacagtgacacttaagttgaaaaataaagatgtaagactgtattcatccattttgggtttcaagaactgattctggatttcaagagttgaagccctactggtgttgttcacccactgctgagggtaatgtctgctctgacattagagttcgccttctatttcttccagaagaaatttcctctgggaccacagtatagtcagccattttctgttaggctgaaaatctgagagttaaaataatcttcctggataagtgacaggaaaatggacaaccaaatttaacgaatgtttctgctgatagctactttctgagagagttttaaaaggtctttatgagaaataccatgctttttagctgtagagtaagatttcagaaaaagacggtgagtggcagctccgatctgtcaggaatgccagcagcataagtaggatcgggtgtccaattaccagaattgataagtaattgttaatttaagtatccttagagtttattgagaattgtttttcagtggctgagtaatatgcaaagcaaattttgggtttcaggttttaatatcttcctgcaacaaccctttagggctttgtggtattgaattaaatatttaagtattgataaaaatgagctgctcattctcctggaatatgtcaactttttcaagaatcacacttcaatggattgtccttagtgtaaaaactggcaggatttcattgaaggtggagccaggaaggaaaattgtctaagttaaaaaagttttttagaattcagatttggaaaaatttatgatttaaaaaataactgccttttctttccaaggcctttcacttctaagtgggtgaagctgaataatataactcttggtctcttataggggacacagaattttccaaattgcctttaattgatgttggagaatctaaaatcagtgccatagattgtctcttctttggtaaagatggcagacattcagattttatgtgcgaaaagtacagcatgagctaaaataagaatccatttcaaatatctccctactagatttgagacaatatgacagtacagtaaagcaaaatgaaaagaaaaattggaaatggagtgtggcagaacattccaaaataggccactttggcagaggggcaattttgagctaaaggcatttaaaaacaacagatacaagagggatactctattctcccctttttcttcttggagacaggagatgaaaattcccatgtgagagatgccctcccagccccagagaaaaaaagaaaaaagaaaaaagaaaaaaaaacccacattcttcaacagggagtcatagccgagagaattctgtaggagaggtctgtacagacagacctttttaaaagaattattatcttccattagcttccctacaaaatgtggttgcttttccacaaatgcctccctttgttcaacctagtataaaagcatttagattttgccacttcttcaggtccttatttccttataaagtctcccatgtcacatgaaacttttacaaatttgtatgctttctcttgttaatgtatcttatgtcaatgtaattcttaggcccaaccaaaaatcctaacaaggcagaggtcaaattttgctttcttaacagaagatagaagttccatattccaattctgtcctcacaactcactttccaatgattcatcttctcaactgtaaaatgggaataatcccaatagttacacattcttcacactgtcaaatatcaaataaggtgatgtactcccaccccctcttctcaactccatcccagcttgtggaataacagggtttcaatagtaaaatattctcttcagttcaattccaacctgcaaaatttgtagacgtctccttcttacctctccaaaatagtccaggaaatcactcaagggcatctcactttcttccctatactccagcctgctcccctgctcctcgtgtgggtcactgatgacacccacagccactcctgatggatgcaatgcccaggtgggtgcgattctatggagatcttttaaattcataaacacaaatttcgaagagccctcaacactgcagcaaaacattgtttgctgatttgtatctctctcatactctcttccctctataccaaagatgacttttcatgtacgctttcctctcttggaaccttctctaactcctgttttcatcaaaaaacctcctttcctacttcactgaaacccaaacagtgttagaaaaaagaaaagtgttagaaatactcccaaaccagaaaccattcggcggcaattccctctccgtttctgtcaccaaatccacaaacctctcagcaacaggatccattttccttctcttcccttcaagcaaaggcaacaatcccgctgtcatggactgactgtaactgctcaccgttcatgttggcaccctcattccacggtggtggtgttaggacgtggagtcttcgggaggtaactaagtcatgattggagtttgtgaatgggttggagtttgtgaatgagattagtgccttttagagacgggagagctagctagctctttttcagctgtgtgagaatacaatacaagatggtagtcttcaaccaggcagagggccctcgccagaaccagatgatgctgataccctcggggatcttgaacttccagcttccagaacagtgagaaatcactttctgctgtcgataagccactagtctatggtagcatgttatacagcctgaactgactaagacaccttcttttaacaaagaacagtcctttctttctttcctttttttttttttgagacggagtctcgctctgtcacccaggctggagtgcagtggcgcgatctcggctcaccgcaacctccgcctcccgggttcacaccattctcctgcctcaacctcccgagtagctgggactacaggctcccgccaccacgccggactaattttttgtattttttttttgttttttttttagtagagacgggttttcaccatgttagccaggatggtctcgatctcctgacctcgtgatccgcccgcctcggcctcccaaagtgctgggattaccactgagcccggccatgaacagtcctttcatttgtattctgtattgtaaccattctcacctggggaaagctatgttctttcagttcttcctcactctatcattcatctgactttgtttggtcatttcatctctatgggaacccacgtttaaactttcatagcccttctacttcccactacctaaccataacactggcccattcctctgctccctacacataaccaaatatctgggaagatttgtctacaaccactggttctacttttgtgtctccctgccatattatttcaataagtttagtcaatacaatacccatatgcaatttaaatcgttatacagaagtacaaattttaaaaggaaaaacagcagctccctgtctcaattctaccaacccctaatttccactttccagagaaggtcactttcaattctctaaactgtttcttatggtattctgcagcacacttggttagcttggctgctgaaaccattggtctgtgtgcctttttcaatggtaggtctttaatcactctccaaacttttcttttttaattggtgtattaaagtcttgcattatttttcttggttcaatttggatcatttatgttttgctagaaattccctctgggatttcaattttgtgctatatgtctcttataagtgattcccagattcatatttctgtctctatctctataattgatcacacaacatcttcacttgtgtacctagtgccatttcaaaattaacatgttcaaaactcaactcctgctacctatccccaaacctgctcctccaaaatttttcctcaactaaataaatggcaactctgttcttcaattgctcaaaccaaagctttggaatcatcctttaatgtttttctttctttcatatcccatccatctaaaaatccttttggcattctattaacaaaatatgcagaatctcaacacttcttaccacctcttctgctgtaacctgatcaaagcaacaatcactttccattttcactgagaacttttactggaggatggaacagccttcctactttgcagttgcctccctggagctcattcttcatacagcagccaatgtgcatgttcaagagtccttatactaattggtttgaaagcatccattgagttcctgtgtcactccatccttattgtggtttacaaggccttacatgtttcatctgctgccactcaacttattttgcctcctgatacccttccatctctttgtactcctgccacacaagcccatttgctgccccgtaggcatgccaagcatactcctgccttagtgcatttgagcctgtcctttccactgcagcagtgttgttcctttagtatagcctggtcctctgcttctttcaggcctattccatacagttacctattgctacaacaatgctgcagagcaagcaatggcaaaacatcagtggcactccaacaataaatatttagtgatgagtttcagctaagctgggcaggacttggctggtcatgtatgggctcactcatgtgtccaccttcagctgtgggtcagcaagtcacctcttgctgatcttgaatggccagactgatatatctgagggtcagctgggtactggatggtccagtataacctcagcagggatgactggagctgtcatctcattcaccctccagcaggctagccctggcatattgttatggttgtgttcaaggaacaagacgcatgtgaaattgtgggaggactttctcaaaaaagctttatgattttctcaagcttctgcatgagcctcatctgtaaaaaagcttgttttggggaagtgagatattgatagatgaggctcacacagaagcttgagaaagtcctgccacgatttcacatgcctctgaatctgtctagatttagcagttgaaaagaaatagatcctgcttttggtgaaaagtgatgcaaagtcccatggcaaaaggcctggataaaagaggagtgaagaatgagagcagtgatgccatcaatcagccaagcatcctttcagtgagtccttcctgaccacccaatataaaacagcatcctctccccacacacattcttatcactcttatccagcgttgcttttatatctgtatctggcatccttatatgtgtcagtcatggttcaattgagaaactgaaccactaggagatatatgttgacatttattgcagagttgtcttatgtgattggggaggatggccaagcaggctagaagtccacaggaaggctccaggaaggttaggttgctactctggggctggtgctgaagcctgcagtccacagggggatttcttcttcctcagggatgcctcagttctgctcttaaggcctttcacctgattgaatcagattatctagggtgacattcctcacttagccaactgacatgtactttagttcatctaagaaatacctgcacagcaaaaccgataattagtggttaattcaatacctggggactattactgaattaacagtctagccatgttgacacataaaactatcattctatacatttaatttttatttatttattgcctgtctgccccgcaagaaagttagctgtatgcaggctgggacttctctgttagtcactattccagggattggaataaagctggaacaagtcaaccccaaagaactgtaaaattgtacttcactgactttctaagtcatatgcttaagctgctatttctttttaaaatcaattttatacaatatgttgattttctcctgtgacatgatacagtcccttatgttttcactccccactgccatactcacattttctacctgcccatattctcgttttagttacagtaccgtttatgatgaatgaatattaaattttcacattactgtgactgtcaatatttttcataggagagacatctagtgcactgtgatcacattttcagtcttgtgtgtatatatatatatgtgtgtgtgtgtgtatatatatttttcttctcaaggagttcattgcctaattttttcatttgctaacttttctaagtatgtattcccaaatatttccaaatactttaaattataaattccctccaaatataatcctgtatattgaggtagggtaggtaccagtttcatgttttttctgtcttcctctatcttccctcattaccttttacgtctgctgcaactccgtcattctgggacattatttcaccgctactcaggcaatactcttctcttctggctttgatctcctgtttcctgaattctaagttttctttttcttggttcattcttacattttattatattattattatgaattacaacctttaacattgaaataggtactccctcatttgattaatgctttttaatttttttatttgctttttgccaggtatatctttgtcctcttatttttagcctttctcagtctctgttttatggatctgttttgtaagaacatagagttgaagtttacattgttggctaatctgaaattcaccttcatttaatagaggagtgagaaccatattgttattaacatgacagctcacaaaacttggtcataagatcatacaatcatataacttatatctgtgatcttagttttgttatatggttttagtttacatttctaaatgttagttgtaaaatatagagacatataaagcctttcaccataagtttattttctttgtaatttaccttttttatacttattttggagttatgaggttttttgcctaatggttacttttatactaacacatttacataatatccttagttgcatctcttttagatactctttactggttccctgtaataatcaatattgataatgcccagtgacttcctattcctcattcttttctttcctcccattatctgatttgtatatgatttttaaaaatttctcctaattcttatgaggcaattgccaagcttattctaccctttacgtattctccacgagttccatttttgttagttttattgtatatacactgttaaagcatgtacaattttataatattttgcccttatctcccaaattaatctatgttctgaagttacatatattcaaggctacctgtgtttatgatcctttttgtttgtttgtttgtttgttttgagatggagtctcactctgtcatccaggctggagtgcagtggcacaatctcagctcactgcaacctccgcctcccaggttcaagcaattctcctgcctcagccttccgagtagctgggattacaggtgcacaccaccatgcctggctaatttttgtatttttagtagagacgaggttttgccatgtcgggcaggctggcctcaaactcctgacctcaggtgatccacctgctttggcctcccaaagcactgggattacaggcatgatccatcatgcctggtctatgatgtattttttatagttatttattgcccatataaggcttgttttctacatatttcttaggaagactataaagaacaataaccctcaaaaacaataacaaaatggccagctgtgaagagctagaacttggccaccccactgctgtgtcatctttctccatccccataggaagaaaccactgtttttttcctcttctcttattttcgttgttgttgcttttggtagctttatcacatatgtgtatccctacacaacatattttagttttgcttattcttgagctttataaatctggattcagactttctaaagtatattgcaatttgctttttccactccgtcttatgttctaagatttatctgtgttgttgctggttactgctgttaatagcattgtgtgcatataccataatttattgcacgtttataacgatttttctttggcatttagaattgaagatcagttagctttttacaaaatcataagtccatgtttttgggtttttttttttcccttgagaatttaaaaatgcttcttgattgtcatttggtacaaagtgttcatatcaaacagtgtgaggctattctgattttctttttacaagttaatgttctttttatttggatgtctaaaggattctttctctttctctgaagttgaattaatttacttgaaatgtcttggtgttgatgattctgagttgattttcccaggttagagtgtccttttctcactttattgcacttcgtctttattcttcagttttcttttacacatatgttgtctcttcatggcctctcttccatatttacctttttctgaacaaaccctgtcctatgtttttccttatacttttgattttttaaaaatgtgttcctatttacgtttcatttttcttactgtgttctctctagtgtttctcggtttttgtgtttctcctagtcttttttttttctttttgagaatgagtcttgctctgttgcccagggtggagtgcagtggcgcaatctcggctcactgcaacctccgcctcctgggttcaagcaattctgtgcctcagcctcccgagtagctgggattacaggcgctcaccaccacatccagctagtttttgtatttttagtacagacgtggtttcaccatcttggtcaggctggtcttgaacttctgactttgtgatccacctgcctcggcctcccaaagtgctgggattacaggcgtgagccacactactcctggcctagtctagcttttatttgtgattttattcctttcctgatctctctccactattctttaatatcctccctttgtctagttctattatttttggaatttccttttttgtgcttcatactgttcatttgtagcttctgtaatttcttagctcctttgagccaattttgaaatactaagttatacatttttctggggtcatcctttgttggtaggttgagtatttatttttaccctctcattgaatagcaatcaattacaaacattttctgttgctcgtgtttaaataagatgggttttcctgtatatttagaaagaagcattagtatttatggttgtgagtgaaccagtatgcattttgaccttcagtgttcgaaatttccctcatcatgggtcctatgaagtatgaataataatgtcagtctttgtaactacctctaaaaaagcattctgaggtcaacttcctctgaactccccctcactagtgtgtaagccttttctcttctgtactgccagcgttcttgcttgcccaatttggattccattttcagcaatatttccttagaaggggcactgtcttaatgaaaggataattttctcgtatgtttctaattactgagaatttgggcatcctctgatcttgctgtagccttttcctttctgagatcttgcgatcttgtactcatccataatttggagtcggtgcagatttctaccactttcaccatttggttctataatctgcttgctgaaattctgactcagattgtggtcctttccttttagagatgaatattttaaagcaatttttgaactctgtctcagaggatcatcagaactcctttcttctgaaatattgaatttcttttcatttttctatttctgcatagctgctgatcatatagcctatagccccagcctgattctatttatgcatattctggggtttgagggggatattttgtcacctggttttgttgataatattgtcctctaaaatttttttctttttttcttttttttaatgagatggcatctcactctgtcacccaggctggagtgcagtggcatgatctcgattaactgcaacctctgcctcctgggttcaagcaattctcctacctcagcctacatagtagctggaattatgggcacctgccaccatgcttggctaatttttgtatttttagtagcgatgaggtttcaccatgtcggccaggctggtcttgaactcctgacctcaggtgatctgccccctcggcctcccaaagtgctggggttacaggtgtgagccaccgcacccggtcccctaaaaattttcctatactattttccttctccatatttataaaggaattttagactctcacaaactatgctgttgctactgttttattgatttgatattgtctaaatatgactatagactaagaagcacatttctaatgaactcatgattcacttatttttagctatagttaaatatgtccattttgactactattcaaatgcactccttttgcaagtcttcaaaaacactctgcttgtctgttcgcttgcttgttaggcttgcttttcttacagtctgtcagcttttcttcacgtgagtcctggtatgcttcctcagggtcagactgcttctctggttctccgtgtagcacctccctgacagtttgatttttagacatacaaacttcagcaatacaaaatgaaagttagagtgcctgtgtctgagtgcaagagttactgagtggtataaaactgtgttttgttgtgtttttcgtaggatataaagatgtttaattggacaaccttattcattcagctgtgacttgcagaaggatctgagcaggtacagttaaagtgctagctaatgaatgttttgggaggtaggctgcagaaattctggcatttcatattttcttccagtctaacaactcaattccacaattggcaaatgagctttaaaggaatactacatgattaaattttttagcgttaaaaaatgattacctatttcaaaaacatcaaatagaaaatattgttggtcatcaagacagaaaatttgagaaaatatttaagtaaatgaaagagagatgtgagaattttaagtgctgttaatagagaaagggaaaatatattaattttgataaattagctttttagactcatgtatctcaaaattagataatctatttcaaagtaataagaaaaatgtggatatcatcagaatgtctttattacactcactataaacttatctgaaaatgctcttttagcatatgctggtcagacagcagtgaatctcagtagctcaaagggagtagcttcccaatgaagaatcaatacagaatcattgtgccaagagtctagaagtgcacaaaattaagtcccaaattaagatcatttgaaaatttctatcagtgctcaactccttactcattgcaaagcaaatgtggtcttattgatagtaaattgcttttactttaacattaaggattatatttcatattgtgtgttcttttgttagttgtggaaatagtcattaggcaacaatgcatttacagaccttagaaaatgtttagtgacccccatcagtttgatgtattatactttaataaaccttactaatggcaaaaatgtaagcttatttcccgagatagatgagatttatttggcagctttggaaatctgaagtgtccatcaggaagtgcagaggaaacaatgttgattcaagtcctcggcccatttttcaatcaggttatttttgttgttgttattgagttgcatgaacttcttatacatttctatgctaactgttgatgagaaatatggtttgcaaatattttctccaaatctgtaggtcaccttttcactttgttgattgtttcctttgctgtgcagaagctttttaggttgatgtcgtccaaattgtttatgtttactttggttgcttgagcttttggtgtaatatccaaaaaatatccttgccaatactaatgtcgagaagctcgtcccctgtggattattctataaatgttgtgggcttagtccttgtgtttaggcctttgagctgatttttgtgtatgatgtaagataagggtccaatttctttcttttgcacatggaaatccagtttccccatcattcattgaggagactgtcttttccccatgtatcttcttgctgtccttctcaaaaattaattggccctatgtgcttgggtttatttctgggctgctttttctatttcattggtctatgtaactgttttatgttagtattatactgttttaatgtaaactggtacagccattacagaaaacagtacggaagaagattgaaaaatgaaaaatagaactactgtatgacacagcaagcccttttctggtagtatcagcaccttctagaggtccctgcactcccatgttcattgtggcattattcacaatagccaagacatagaaacaaccttagtgtctgtcaacagacgatgggggaatagagaaattgtggtagatgctgaatatttgttaatttacttgatcataataacaatttcactatgcataaatatatcaaagcaatcatgctgtatacatctaagcaataaaagcaaaagaaatgtttatttggaaagaatctcagaaaggaagcttaaagtattataaaagagaagtttgttatttcaaagacaatggagattatgaaaaaagtgagaaaaaaactactacctaaagatgaatatatggaataatgatagtgagaagaaatataaaaagtgaaaagtaggctgggtaaaacacacagtaagtgattatatgcatttgtatgtatatgtaaaaatttatatatggaaatttcactagggtacataagtgaaaattgaagaggacagatcgaagaatcaggaaacttgaaaatagatcaatagaaatgatctagtcggaagaacacagagagagaagattgcagaaaaataaacagaccctcagagacctgtgggaaaatatctagcatgaaatagatgtgtagtatggaaattcaatggagctagcatagccaaaacaattgttaaaaagaagaaaaatggtggaagagttataccacttaaatttgaaacttactaaaagtccagagtaaccaagacagtgtggtattggcacaaatataggcagatagatcagttgactcaactgaacataaatgagaatccaggaatcaattcttatatttacagtcaattgatttttttttttttacaaagtgatcaaaacgaatcaaggcaaaaaaagatagccttcacaacaattagcactagaataattgtgtatccacatgcaacaaacaaacaaaaaacttgaacttcagcccttacctcatactacacaaaaaaaaattctaaataaatcataggcctaaatgtaataattattactgtaccatttcaagaagaaaacacaggagaaaatccttacctttggttgggcaaagaattcttagacacaatacgaaaagcacaattcactttttaagaaatgtgatacattggacttcataaaaagttaaaagtttaacacttcaaaagacaatgataagaaaatgaaaggcaagtgttagacagaaaaatttatttgcaaatcacatgtctaataaaggacttcaaaatatacaaacacacttaacactaagtcataagatgaaaaaattagagggcaaaatatttgaatagacagttcatcaaaaaaggtatatgtggccaagaagcacatgaaaaaaatgctcagtataattagtcttcaggaaaatgaaaattaaaaccacaatgagatatcgttatatacacactagaatgtaataaaagatggataataacaagtggtgacaagaatgtggagaaatgggaatcctcacacattgctagtgggaatgtaaaatgtacagccactttgaaaaagagtttggctgttgctcaaaaggaattatacagaattactatatgcctcaagaattctactccttaatgtctaatcaggaaaaaatgcaaacatatgtacatataaagacttacatgtgaattttgatggaagcattattaataatagtgaaaaatctgtaaatattccaaatgaatatcaattggtaaatggattaagaaaatgtgatataaccatgcaaaagaaaatcatttaatgatcgaaaagaacaaactcccacctcatggtacaatgtggaagaacttagaaaccattatgctaagtgaaaggagatatatgtaaaagattacatattgtatgattccacttaatgaaaagtccagaaaaggcaaattttcagagacagaaagcagatcagttcttgcctggggctaggtgttctggtgcaaatttaaggatgtatgtaatgtgtgaatagcttgcggcctttctcttctcagccaggagtatgcctgccctaaccagctgcaaccttggggtaagagcatttggcttgtctcaactcagagcctccgagaagccactttcgttaacaatgctgctgtgtttcacactgagtttctttaacagcaaagaggctggtcctcatggtttgctccatcctggcagaagttctgccctgagacgggagaagccccaggaaagaatgtcacagaattctactgtttttacctgaagttcaacagtttttcaagcataaatccgtctctgattgttgtatgaaaacaacatacatacaatggatcagttttgtcctgctttatagttgctttttgaaaaggatttgctgatctccttacttggccatcactctacacccactttttaatatgtaggaagaaaaaagaaaaattaataacaactggagattggaaaggcagagggcatattatgggaagaagcattagcccataagcattcagttggtatcttacctcatcagttctttcaaaggctctgtgtatgtgtgtgtgtgtgtgtgcgcgcacctgctacgaatacaaatagcttgctacaaaatatcactctcggaaagagagtacttatgctctaacttataacttatgctgtaaccgagtgtacaatagaattctattttgacttggattctccaacacaaagcaaagaagcaatgaatacaatttatggtgttgtcctaaattgctttgctaattccctaccatatatatgtctccctaccaccacttcatataattcatacatctcaaattattatttacaagagatatatacacacaaacacactatacacacatgaacatttgttgctttcttgtgtggcatatttgtgaatttttcaaggacgaatgtggtaactcctctcatccctggatgcgtgcccctttgcaatgtgatgttgtctgtcctcttgtcaagaggtgaagtccatttctcaccttctgaatctgtgtgggctttgtgacttgttcagatcaagagaatgtagcagaaggattgctgtgccactttcagtctgaagactgaacttctgctctgccctgtttgaactctgagatcactataaagaagcccaggacagttttcttgagggtgagatactttgtggcatgaaaaactcagctaatagctaccatcaaccacagataggacaagaaagccactttaattccagctgagcagcgagatcacagtagctacttgagtgaacccaggtgagaacagcagaaaaaccaccacataagccagcctaaattactgaccctcataattctgagcaaacaaaatgattattgttctaaaccacttaagtttgtggtgctttgtggtacagcaatttataactgagacaagatgttcattttacattttctttgttaatagttatgctgaacagaacatcttaaaacatatgatggagtaattcttagtctacttcaattttttggacaccatctaatgtcagaaagtatagactttaaatagttcttttgaaatttgtgattatcaagttttacatggaagttaatgaaatcaatattgtttttatagggttgcaggtgatttttaaggtctggaaattttccagattcattctgcaagttaatctagcaagtggcattctttgctcttgttgcctgccatctctttgagataactttttaaaggaagggggacaaaatcattatggattctttaatcaacagcagttgactatctgctttttactaccacttgcaaggaaaacaactcttaatttcccatttctaaaatgccctcatgtagtagattcctaattacttgactgaaaaagtaaacatcgtctaatgcttgctcagacattaaggtacataggagtgattaccgagcgtgtctgctttcctacctaccaaatgctaaatctattagtatttcctggtattcttctgaattttgaatactgttcacataaattaaaaagaccaacatacagagaaatttatgtcattttccccctattaaaaatataggctagataaggtaatggaatagcaataaaaactctttttcataaaattcttaagtatggcttcaatctgcaatttctttttacattgcacacatttcttttgctgcaattatctaaataaaagtatttgtatataactattcatagcacatcagatttttattttgtttgaggaaatatgcacatgttttgttcatcctcaattaaattatttaccttagaacttcatgatatatctgcttacctaccaggaatccaacacctgcacatgcaggcttgaagagggtttgaaacttgattttaaaaacacttttaaagaataatgatgcataatgaatattactttcgtatttcaagtaacaagcatcacccaatggaaaatgtgtgaattaaatgtccctggtattcattactactttgaaacagctgcaacaaaggattcgttctgatataactatgtgtcatcctggcatgttccatgcctaagtaaatttttaatcttgacagatcatcaaatagaagaatttcctttccagagaatgcaagtattgggcaatacaaattcagattataagaaagggttacactgacttccacaatgattgaactagtttacagtcccaccaacagtgtaaaagtgttcctatttctccacatcctctccagctcctgttgtttcctgactttttaatgattgccattctaactggtgtgagatggtatctcattgtggttttgatttgcatttctctgatggccagtgatgatgagcattttttcatgtgtttttcggctgcataaatgccttcttttgagaagtgtctgttcatgtccttcgcccactttttgatggggttgtttgtttttttcttgtaaatttgtttgagttcattgtagattctggatattagccctttgtcagatgagtaggttgcgaaaattttctcccattttgtaggttgcctgttcactctgatggtagtttcttttgctgtgcagaagctctttagtttaattagatcccatttgtcaattttggctagaactagaaataccacttgacccagccatcccattactgggtatatacccaaaggactataaatcatgctgctataaagacacatgcacacgtatgtttattgcggcattattcacaatagcaaagacttggaaccaacccaaatgtccaacaatgatagactggattaagaaaatgtggcacatatacaccatggaatattatgcagccataaaaaatgatgagttcatgtcctttgtagggacatggatgaaattggaaatcatcagtctcagtaaactagcgcaagaacaaaaaaccaaacaccgcatattctcactcataggtgggaactgaacaatgagaacacatggacacaggaaggggaacatcacactctggggactgttgtggggtggggggaggagggagggatagcactgggagatatacctaatgctagatgacgagttagtgggtgcagcacaccagcatgtcacatgtatacatatgtaactaacctgcacattgtgcacatgtaccctaaaacttaaagtataataataataaaaacaataaaaaaagaaagggttataataaccatttagagaaggaggtagagggtagggttcaggcttgaacaggattcttcatcataccgtattctcctgaaatggactccaccaagatgtaagaagattaagtccaaacctgaggtacagtgccgttttgccttctgatagaattggtggctattttttgctaggcagactgcttaactgaaaagactggctgtgcttttattttagtctcaatgagtgtgctttgttttttaaaataaacttccattctccctttgggaatcaacttgaagtcaatcttatacctccttttcaaaagtttttctgtgtttaggccattgtgaagttgtctttactgatctgctgctctgagggagtgaaagggagccggggaattgaaggaaacctgtgaaagaggaaataggacttcctctccctttcacttggcacttcaccctcaaagtacattccacagagcagcaacatctgtattatttgctagctcctccaagatgcagaactcaaggccttacctgagacctactggattagaatctgctgtatgacaagatctcggtgtgctttctatcctcagtaaaaattggcatgcactgacccaggagaaagcattagatcaaatgtgccagcctttcgctctctaatggctctcagatggaacatcctctaacctgggtattcccttaaggaaaaataaacgactagacgccaggagctctggtagtttgtttctaccaggtgtggctttgaggaaatcatttaatttcccagcttctgtttgctatttgtaaaatgatactctactattttgtggcatatcttttgtaaggtacagttttcttacttactcctctctgttgacgttgagcccaaatcattatttaaggagagaaagtctccttcactcacgagacatacgttcacttcaccagcatgtacttattctagccccactcaagccgagtaaattaatttaatttgtttcaattcaagctactgtaagctacatcaatattaatacagttgcttacaaaaatatattcttagataaaaccaattagtacattagttaatttacatatccttttttccacagggggaaaaatgtaatgacctgtaactcactatatttagaatgtcattccttcaattaattagcttctacaattgaaattataatatattgtaaactaaatttctggcagagatatataaagatgtacacacttaaatttaccttcaaaactcaatggagttaaaaatgataactataaaatatactttgatttataatttacaaagtcctttgcctacatgatttcattaaaatatgaaaatcctgtgcaactttcagttttgttttgttttttgttttttttttctgagacagggtctcattctgtctcccaggctggagtgcagtggcgcgatcctgggttcaagcaattctcctgcctcagcttcccaagttgctgggattacaggcttgtgccactatgcctggctaattttttgtatttttagtaaagacaaggtttcaccatgttgaccaggctggtctcgaactcctgacctcaagtgatccacctgcctcggcctcccaaagtgctgagattacaggcgtgagccactgtgcccggccgcaactttcagtcttaaaacagctattatcgtaggctttgtaaatttctttgaaatccttaatttaaagcataacaaaagtggatttattatcatttattgtgccataaacaattatttcatgattgttactgttattttggtattctaaggatttaggtaaagaaaagtgctgtttttctagaatctcttctcactacatatgttaagttcaatatgttcagcctaatttgacataaggtgcagacaatgaggcaccaatttactgagcctgaggatacttaagattgatgttttcatttgatgtctcacttccaagctatattagacactgtaggttatagtctgtgagagccggattaactctcagcatccaaaatgcgtttcaatggcttagtgacaaaggttaataaagaattgaggataaacattgcaaaacagtttaaaatgatcctgaaaataatgtgacaggcatttcaatactaagaaatgtcacctctttcaaaataaaataagagaaagtagaacactatttttcatgaggtaccttttgtttgattgtgagcatgtcaacattgttttgtcatcatttgagcacagaaacacatttttccccatccaaatattgttggtgattaaaaatcccctataagtaaaagcttagttggtcattattaaatggtatttttaatgattaattctttaattatcaataagtcactaaaataaaaaattttttcctataatacacccttggtaaacgaagtacaactaaaatccatcttggcagttttttgtctttttaataaatgtttattgcatatctattatgtgtcagatgctgtttcaaactttgaaaagagacaaataaaacacagtttgtgccattgaatatcttagagttcaataaatatttttttaatcttaggaaaaataaatttgttaacttgtttgagaatgaaggaaatgccttattagcaagaatatctaatttatataaagttaaaagcatagtgattaatatgattataataattccatgtaaaagaatgtcagatccatattttaatgttaaaattcaatgagttttttttttttttggcaaatatatgtgttactaagtgctaccctctgtgttgtttcaggataaagggagaaaaagacatacttggttcctgttctaatggatcttttattctagtaaaagtcagattaaaatgaagatcctagaaaagtaaacccaataattacgattagcaataagaatgcattctaccaacaaagggccctgatattggggtaggattaggaaagaatcactgaggatttgatatgttctagctaggagttacaggatgagagtcagtttgagaaggaggaaaggcatggagaaggcatccttagaagatggagcatttcattgaaccgatttctggagcttattaagattattccatcagtaataagcttaatatctgtgattccccaaattatgtagaattttagagctatgccatgagaaaacaaatcaaccaaataccaaatgtatcaatcatattttctttgctacagtcatgtatgaaaataggcagaaacatggatccagttctgggtaacacaggttgtaaaccttagttataaggaatgacccctttaactccattaacttctttgctgtgtgcataatttactttgaacttgtttaagtagaggttagcctactttcattcagctcaaaacccaaatttgaccagacactagagaatacaaaaagaatttcaccaaatatttcagaagacaaaacaatacataatataaactaatcttaatatttttcagggacttcattttaatttatctattaagatatttactgttttagttgtttctattggggttttacacatgtgactttcccaatctacttagaattaatttttcatcactcgagtatggaagcctttccaccacatcggctccttaccttctgtctttcatgttgtagttgccaaatgtgttacaactatatacatagaaaactccatcagacagtgttacagtttttgttttcaatcatcacacatattttaaagaaccaaacagtgaaaatttgttatatatatgcagatatttatcatttctgtggtgatttcttcatttctgctttgagctgaatgctgtgtcctcctcagatccaatgtgatggcggtaggagctgaggacttttcaaggtgattaggtcatggaggtggaaccctcatgaatggggttggtggcctaataaaagagacctcagagagcccagagaaatgccttttcccttctgccaggtgagggtgcattgagaagacaccttctaggagcccaaaagcgagtcctcagcagacactgaatctgacggcacattgatcttggatttccaacctccagaagtgtgagaaataaattgctcttgtttataagccacctagtccatgatattttgtgatagcagccccaaaagactgacataattcctgaaggtccaggtttccccttggtatcatttccctttgatctttcccatttctttagagcatggttgttggaaacagtctccgagttttccttcatctaagattgcctacataatatttttgctaacttcagaatttgcacgggtgcttctttttgtttattattttaaaagtgttattcccctaccagcttgtctccatggctgttacagacaggaagggccagtgagacgttagcagaaacctgggatagttctcccttaaacttcatgaaactcttgaaagaaggtgacttagctgggtgaagtgtcacatttgtcacttgtccttctccttattcctggctggaaatcagatgttaagtctgtagctccagtggaaaaccaatgacttcagggatagaagagaagatacagaaaaaagcctgggcaatggaagattcttttgagtgtgaggtctgctctggcaagcctactcctggactgcttttacatgagatctcaaactgggtacctgttagtagcagctgcactgaatttttaatggacatcaaaatcatgtctcttccttatcatacatgctggaagaatctctgttacataacaaacattctatatatgtatattatttaaattgaatatgttgcttatatacattttaaaatttattaccatgggtgggagaatggaacaaactctcctaagtgagatagtgacttcctctctagttgcatgaaatgtgttttacatttcactatgtaacttgtacgcactaaaaagcttctaacttgtattgttgtcttttgatatgtatctatatcttatctatatctatcttgatccataaaaagatagtagaccctgattatttagagattgcttctcatgccttgttttccagaggacctagcactgtgcttatacatgatgctagtaacaactgaagtttactaggcttggtttcttcctaaacccctatgtaatagattctgtctctctagtcagtagcccactactgaggcaagaagatttcaaaggatgctaagatataagacaagaaaattattgaccacaccattctattttgcataaatgtaaccctttgaaacattttagatgccaaaatatatgatatttttctgcatatctgaacaggtgattatgctggagttttgaggatcttaagatatcatggaatgataggaaagatccaaagtgattagtgctgagaatatagaaataagaacaaagtgaaggtggggaaaacagtatttattacaaacaaatcgttgttcttaagaaattgactataactattaaaatgactagaatatttaactatgaatgtgctctgtctgctctaccgacagcaaagacttagcaatttctctaaatcctatccatattttctaaaggtgtcaattgcccttttatgtgtgtcactttctaccacttttctgtcacttcctgtgccacaaatttgctctttttcctatgttcatcatctcattgaatggcacccccatctgcatggtagcctgggaaatatattaaggtattatcctttaaccttctttctttatcatccctatgtccaggtaatctgaaattctgtcagaatatgcatctttaatctatcttaaactggcccatttttaaaaatttctatctatcttgaccttactttacctaaatgattatcactctcctaattgtttcctaatgggcctcataggcaagacaaatctttccttatactgcctctagaattatcttttcaaacacggatgtggccatccttctttcttacaaatgacctcatagtcccaaagacaaagtctatactctccctaaataacattcaaggccctcactcacgcagctccctgattcccacgtcagtatttttgtcctcctccccttcccaaagcacactctcacatacgcgttattctacctgtagtcatattaagctactttcaattctgtgctttctctcagccttcaaccctctcttaggctgttgcattcctgtggagtgttccaatccatgcacgtgctaccatgcacccacctttcttcttagaactagaactgagtaactttgttctcttactagaattacccctgcactattaagtgtgcatccctctcccacaaacctcatttcatccacacagagagaactctaggttgtctaagggctggactctgccttattcactattatatctgtagcacttagcatgagcctgtttgaggaatgcttagttaatcaatattagaaacttctcattgcagatgagtttataattctttcagttctcatagtcctgtggaaatgaagcaaactgtgtgtgcatgcacgtgtgtgtttgtgcgtgtgtgtgttgtttgtgtgtgtgtgatggggttgaagaggtaaagtatattaactttcagtgaggtaattgtcctgatattcatgcagtctgctctgcatcaagattacttgaggacctggcacgggaactattgtctagctcctgggttgttcctgttattctagctaacagcagtgattacgtttgaagttctgtctcatattgttgcacttctgttgatatttaataaaaactcagagaacaacttgcaagaagcagtactcattcctgctgagaaaagaaaaagagaaacaagtgaatcctttgctaagccatttcaaatgtttctgccataaccttaatagcataattttaacttcttggcactgagtgaggtcaacattggtatactttgtactaacgcattataccggaaaattggatccagaggtaaaatggagtttccttttctcaaaagttttctagccaaggtacacaatctatgaacaagaggaatttgatgagaacactggtgaagtgcatactcagacagtaacttgttttctcatgtcctgaagtaccaaaaccttacttcttttaggctcccattcatatttaccattatttctattttatattattttcatataatttcaactacagactagggtaatttattttattgtagaatatttagaaatctgggaagcaccaactaaagcgagtgtttcttgcatgagtagaccctttttaaaaaaaaattacatttgtgaagaaatattgctgcatttaaacctcctagcagttaaaaaatgtttaatttctagttttaagagtcatgacaactttttctttttaacacaatttctcttagaatcattaaagtcaattgctaataattgcattggcattgtgataacttgagatgtaaccaaggaaaagcatgttcaatatgggttactaattacactaataacaatttatgcaaattagtgactaattttacattagcatagtggtaatcactttaagatcgtttagtaagaatgatggcccaatcaagactaggaagtattttttttaaatgagatagagaaatgaaagatatagggtttattgcaaatagtttttaactgaaatccaaatattagtaatgaactattttgaaaggaatgtattgagtaaaaccccataatttatcattcattttcttctgagtattttccacacattttgatctctagaatatggcacctgggctagaaatctctcagggaccgtctccatcatgatttttctggaatttcctgtttgagtcaggatgaaaatatccccgatatgctctgtttttggggatttagccccgtgcttccacaacttagagaatcaagagataaaagaagctaaaacaagagaaatgtggttaaatcatgattttaatttttcagagcttcttgcttcatgtaaactaaaagtttatggattataatcctcaaacagccatacataaaaactgtatttagatactttctttgcctactaacttaacacaacttgagtcaaggtttggaagatttcagtatcggcatatctggagctttcttagcaaaacaaaggtgacagagggttgtaattatctgagctatagccatgtgaagagaagatgaaggacaactgggtatgctgtaaacaattgaggataaggagagaggaattaggaattaagtttagacagcaacttcttatacatcttgggcaaaatatttcacccctccagctattgaactccgttggagtgcttctagctttttatttttcttcttccttccttctttcattccttccttccttctttcattccttccttcctcccttccttccttccttgttccctccctccctcccttccttcctctcttcccttcttcctccctccctccctctgtcccttccttccttccttccttgcttcttttctttcttccttccttccattttttttaaagcggtggtcttttaaatatgtgaccttaagaatttcaaattttcacaaatattcattcattgtgtaatttgagaaatatttattgaggaccaacaatgtgctggacactgttcaaggtgctggtgcacgaaacataaagaggatcaaagcacatgatgatgtggtgaaaatagaattgagtagcaggaatcttgtcttcttggactatgccttgaacctggcagttgtcctagagcacagtttgaaatccattgatattttccttctctttctaataacctatgattccacaaagaaataatgcacgttaagtagctgccatcataaatgtacctaggattgccatgatcaggttcttggtgtacaagttcatcctatttcacttacattgattcgctttctagatgatactctactttgagaagaagtaagcaaatggatcacattcttactttaatgagatctttggctgtcttggtctcagtttttctgctctgtgttcctgttcatttttatctcactaaagaggacactgatgttctaagagttaccattattttgcacaaccatccagggaactcttaaccatttgttccaattttatctaacaagtaatgatggtgtgtcaagggatagttatattctattttatatccaagcaagtcaagctagaactgaaatatgttctattttttttaatctgggcataaaagacagagacagagagcgagagagagactaccagaagatggtgggaggtgagagcagttgccattcaggatttacaaggaatagtcatatcccacagttaaaatatataaccacttatctttgcggccagtcaatgataatttcctctggctccttcagtttgaatctgccaaataatgtaccaggtgttttctttttctcttaagagaaaaaaatgatctctaaaattatatgaagtttaaatgatttaattcctggttagaaaatttagcttgaaatctaatggttatcatcaccttatatttcaataatatttcatttcccacacctgccttctagagcagtttcaatcatgaataacagtgggggagaaaaatgataaacattatgtgctcagcaaaggacttagtagtgttgagccaagttggaaaaggagaacaactattactacagggctgaaccttgtggggagtctggaggtctgccctgacaatcccaaactctgcaactttattatctttgtggttttaaaaagacttgatctttctaatattacattctgaaaggcaacttaatagatactctatttctggagagctctgtatgcagaataatggaaaattcttgtcgtggttgtcatgtttttttgaagaagcagcaaagtgaagaataaatttggctgatttgcatgaagtgttagtattcactgacagtgattcctgaactgaattttctttatgctgtgggagaagagacgtgaagcattatttctagcagctgggatggctcagggatttaaggtaccatttggggccttgccaagatgctccgcatgaacctgggaatgtcagtgcagagttttggtgaatgagacagagctggcattttatagatggagcaggtgttggcttatgtgatacgacttgagaatgtgtaagaaggtcttcatgatcaaataccacacttccagtatccatcacattatagtcattcctctgagataagatctgacatgctcctattaacatgaaaatgagttatctgggaggtgtattagtcactgctaccttagcaacagtcagcttatcagataaagtctcagaaagtgggatcttgaatgaatggtactcacagaggccagttttggttaagagtacaaagatgggccaggactaagtgaggagatccagtggagctagcagggagggccacaggggagggccacgtacatgactgtgggatgaattcagccttgactcagttcctacttccaccaaagtaaggagtgtacagcatcattgtgccatctggatatttttgtttcacggaaactccctagatgttaaccacatcctgttttccttcaaagcatcacttaaacatacagtgtttagcatacagagtggggatactaagtcttctttctctacatctccagcattccttgatcccaacttaattctctccacttaattttgacgaaaaatttaactttctaccttcttcttggctccatagctacctttgcatcactgaagactcacaaatggtttctgcctcacaatgagctatccactctatgtcctaacctttggaggtatagaagggggaggatttgaaagttgagtctttccattttcctttcccacaggtttcagatagtagctgaacatggcatagaaatttaggaatttctcttcctcaacaaccccacctgacacaagcatcagccacggtgagcttggcgatgatctcccttcccctttgctacgtaagtgtgttctttgatatgactcaattaaccaaaaattagccatcatgtatctttaaatggctattgacaacgatttctgctagataagtgttctctcgggtcgtgtccctgactaacctgagcttacgacctacccagaaaggttagagagatataccagaaccagagtgatagattgcccatagaaagcaagcaagagttggacacaaagtgctgaatgagtgatagagaatatatgatctttgttgtcccagtatcctgtacttccttttttggtagcttttattgcaattgtaatgaaattaattatctggatgttatttaacatcttgccttcaccttttctttcaccttccctttcacatcccctgggtgcagggtcctggcttgattttacttaccattgtattcccagaggaacacaataggttcagaagttcagaaaagtgagcagtcgctgtccattgtgaggcttaacaaccatgaccattagggaaggcttcccagaggtacttcaattctagcaaagggaaagtccaaagattgctatggattagtcaggtggtcctaagccttggtctacaccacaagacttcaatgacatacttttcaatctggggatctccaaactgttgttaggtcaggaaatagtggatgcctcacatcctagtgtgacttggacagatggccaatataatctggcttaacctgttcctatgtgtggtccagattaaagtcaccacagaaacatatccagtttccatgggtttggcatgatggcagcctgaactctcaagcagttcccaaactctagtttgttaactgttgcttaaataagggatctgaacatttggaaagtagctccatgcagcaccatatctccgaaatttctcactgtcttcaatggaataggtctttgtctttcattcttgtatccaactctcctaggattcaaaataagatggcagtcgacccttctgtgggatccataactgtagtacagtgtgaatgggaaggaatcttcaaccataaataggttttttaaccttctctgctcctcctggaaaagaaaggcaggcagctggtagaacatttctgcactgttctcaattaacttttgcttgttcccctcagtgagaagagaatgagccatctccacccaactgtgctgtgactggagcacattaagatgcacaaatagcagcctagcctttgagtctttcttttcatatttttgcagacagcttcagtccaaataaggttcttactcctcctgagataattcctaacatttctaaatgggtttcaaattccccaccagttccactatcagtaatgagcaccatatttcacaaatgggcccgtgagttgtgcagatgcacattttgtaactgtattcggtttcattttgaaatattttcaggaactctggaaaataaattatttagaaatggaggggataaacaccacattacaattataaagtgaatatggaggactaagaaaaattaaaataaaaacactcactagcaacattctagagttattttactctcctctgccttggaatattatgcattttgttctactcaggtgatttttgagctgcattttaaaaattactttgagtcttgaatatgttctgtggtgatagaagtttgcctttgagggtgaactttaaatttagggggctgcccaaaggacagaaatagcccaatgaataaggtagatgattatggtagatgatatcaatttagttgaaaaaaataaatggaaatggaaaagattttctccaaatggattttacgttgcagcatgtgaaggctaataaataccgtaatctctgaaaatgactcttttaagaggttgactctagattggcatgcttttttcttttctcatagaggctatatgtattgtgtttttatttgtcctctcatttacctggaattatgtacctaaatagtgcagctggagctggatctcacaagcatcctggaattctggtccacttcaaacaagtatttgattacatcaaatgtagttaattaagataattacattgtgcttttcctcagaagaatactagaagaaaataaaaaacagaaaaaacctcctgtattaataaattaaatatttgaaatgcttctggaagtgttaaattatcttcaggtgggcaaacttgttctaaattcaagcccaggtggtaccttacattttttggggggcggaggggcgcttctcctagagcatggattcaattaaagttgcctgacagtgaaaaatcaacctattctaagatgcaggcgaagctttcttccatagcaaaagcactgttctgcttcttggcttcagtcattgctttgtttgcactttttttccctaagttcacacttaaggcacattttaatgcctgtgaccaccacctatttcctgttattgtgtttcttatgataggctgccctccttggaactcttatcttctcatcatctctgagtccttttagttgaggtgaatttgccagaggcagggaaaactgaacgagctctgttcatatttgaatgggaaccacaccatagtatactaaaataaagcatgactatccaatgtgtttaccacttttgttgtggttttattgttgtgttgttttaactgtgagcccgaattggaactttttaaaatttcagacttctatttttcccctttgtcttttttttttttaaatctccaagcttggaccttaatttgtcaacagatctctttcacattatttttggctaaaggcagaaagaaattgtgttgaaaaatattatgagaatacctctcctgctaagttttgagcccaatatatatagtagactccagaggtttggattattcagttaagattgaataaaacatccaatgttttagattatctgcttaattaaatcccaacgctgaactgctagaggttttcttatctagaatgaactaagtgaatattacagagtgacctaagttgtaggcaagtgagctactgcttatatgtgaagggaatccaaaacccaattggtatgtcttcataacatggctaaggacaagttgagtttatgtacatttctaaggccaatagacggtttgcaggacacttgtttctgacatgattaatatatgaaacgtgtctgaattaatctgattattttaccaagctatatttatttcaagatgaattatttaaaaaacctatttaactggtaaaaacttggattcttaagctcggaggaacaagcaatttaaaaaatttctcagcatatgaacaatggtagcaattaatttaataaacagtttctgagaatctactctatattagatgctgtgataggcattaatgatagtggaagcagaaagacaatattcctcccttcaaagagctctgtctaatcagagagacagccaagtaaatacacatttttaatttaaatgtgctatgagctttaacacaattatgtagaaagctctgtgggggcaacgaggttgcacatctaatattgtaggtgacactttacatgaactactcagtggttgcaagatgtacactaaatccagaaggaagagtaagaatttcctacaagatgagaggctaaaaggaagtaaaagggaattaatttcagaaatgacatcatatgctagatgacaaactagaaaaccaaaggctgttatttatgtatcttcacattatattttatctgtattacactgtatggcatattatacaacatagattatctgtgccttagttttttaagtgtaaaattggtataatgataggtttttctgaagactaaatatattagtacatatgaaacacttaggaaagtgctaagaatacagcaaattaatatatattaactattatattagctattattttcatgtttatccgttcccactgataatgcatagcaaaagcacagggtggttgatcaatgtattcacttattcaggaatatttattgagcatgtactatgtgccagatactggggattccaaagtaaaaagaccataacctcccctcacagtgcttaaaattccaatactgagatgaaagaaagtaaatcatcacacaaacagcggtgtaaatttagagactaatagacattgaaagagcaggaaaatgcttgaaggtgggcaggagacgcttcacttgttgtcattgttggattcctcctgagagacacagtaacctaaatgttaaaatgaagacagccctataaaggcctgaggtaggaaaaagtttggtatgtcccagaaatagccaggaggccactgggattggaagacagataatgagaggaagagaaatagtagataaggctggagagacaggcaggggctagatcacatagggctagataggggaggtaagaaacttggatttcatttcaagtgtaatggaaagtcccttccaaatgaataagatctaagaggcacagtcagtcagtctttcaaaaacttcttcacttacctcaccgtgtcatcaagcccccaatataacttgcctgaactgttggtttcttcatatttttccattccccttcaaagggcaaagccatcgtgttaccaggaaaccatggaggaaatgtcccaggtgccccattaagcttcacagttaaaaaagtgaaaaagacaattcttgatctcaagaagctcatggcccagagggataaatagacacataggagacatgaagccatggagtcgtgagtgtggcgattgagacaagcatagagagagtgctgggggagcctaagggagctccacgttactcagggcgctggcctaggccttctgaagaaagtggtgagtatgagttagtaggcaaagacaactgcatgggagaaagtggcaaggtgcaggttttccaggcaaggtgagcaatcctgagggagagtccggaagccagaaagcacagtgctttcttgagaaggaagggaattcagcatgacttgaattggagcccagtgccttaatttaattcaaattttggtgctgcttctactccttcacatttttcttaaccttcctttcttctggatccatactgctttgtttggccattactgacatggttatcaatctaatctttaataacaatgatttttggcaagatactgactctgaatattgatctgctcacatgtaaaatgggttacaaattcgtatatcacggtgaggttgtgaaaattaaatccacatctcacagtgtgggttaataagtaatccacacctcatggggatggacactagcagagcagctggcatacagaaagggatcaatgcagattcatctagttcgattcctcagttgtttttaagagaatgctcaaattccacaaacctctaatactttctattatagtacttactaaagatcttctcattctttctaaattttcctcaagctctctgtactgttttactactcttgtccacatttgtctatccttcctttatcaaaatggattcactggctattttttgaaagcactcatctcttgctttgaaaccttctctcaggcttacaagtcttctttacaatacttgcaaagcatttacttcttcattatcctatacagctagtcttctatcatgtaggataggaagagaaattgtgacttctttcagaatatagcttttgaaaatatttcacttaataaaataactgtgataaacctttctttttctaaaaaaaagactgagataggtttagaatttttctatttttctccattatcttagcatttttgatgattcaaatgaatgccgctagagattttttcctatccccattttttttgcatcagatctttgaggaaatgaaaaatagaatggggataaacttcggtccaagtttactgaacaaatacctatgacatgactgttatgttcacaccctctatgaatctttgtggttgaaggcttagtgtcgaatttcccagtgttctggaaagcttaggcagatgaggtacaagttgtatgccaggaccgtcagagaatctatttatttggacactggctaagataggctagctggcatctatatcatagatgaaaaccaaggtatcactaaatttaataacacaccccaagcaagttcttgtatgctcatgatctcattttgccagctgtttccttctatcccatttggcaccaagatttttaaagacacattttgttccagaccttaagggataactgctggcagtaaatttttcatatataaaattcttttgtccactaaaatagttgctccttgttcagctttcttactgccagtgtgaatggaagatatttgactctggatataaagggcatgtagtcttttcctctacttcactatcagaaggtgagcccatgatatacaagagaggaaaactaaaattccacacaaggtactagtgagtcacattgagcagcagcacacattctatcttacccctcctttggttctttgggatctaaagcgtcatttttttcacctcattttagggagctggtttggattaaagtcacatacaaactgagccatctccaacatctacatcaggaagtaactctaactcaagatagaggtcactggaggggcaacaggtttgtattgcttattctggcttctcttttcgtgtactggagatcatttggaagagctaccagtgactgaccctttataagcattatattttgaaataaaagcgattgcttgctcattagcacttcccttgatgaagtatacaagtgtcaggtaaaacaaactgaatcctgctcatgatggattggaatggacattccattgggagatatctgagccaaaaccacaaggctttggctcctagttgctcatgaagcttctaattgactttcataccacttgccaattattgctcttaagaacagtccttgaagtagaactttgatgggcttgtgcatttctaatgctgaaattcatttgatctgtagtgtctcatggattttacccaccaaattcatttagaagcattatgtgctatttaatgggagattatatttgaagagttaatataatatgaaaatctaaataattcaccatctgtaaaaatgatcacttaactacaccttttgaaaggcattagaatacaatatttacaaaagtatatttttcagatttaggatgtttttgtgtattaagtaaattgtaaaaaaatctattgatagttacactgattttaagattactcattgtaaagctttaaagtatgaagtatatttaagtatcaaaagtcttattaaaattatcttcatttcttgcatggaaatatgttcaattctccgtattttaaaaggaaaaaaatagacaaatgggcatattggtcaaaaaattagaaataaatactcatttttaatgtattcgaatttgtgaaaggtttattccactgaccatatcttcctgaaattttagagaaatgaattcaaaaggttttctatgcatgtttgtggcttcgtaagtaggaatgctatccagcagacatttatttaaaaagctatctataattatgagagcaatctgactcatttcttctgctggcagactgaatcagagactacttttggactaacgtcaagcagttatatagaatattttgtaaaagtcagataagtagtaatgttctgcatttttcatcccatttatatataaataaaacatgattatataaattgctgaaataaagattgtagctatttctttactcaaagtactctggatatgtttgtgaataaagaacaaaggaacattaatcatagactatgagaaaatatgtttcaattgtctttatctatattcattcactgactgaatacatttttcacactggagaaatgcacagatgattaagcccagggcttaaatacatatagggcattctagaaaaattcaccaatgttaaagctatggtccttaatttcaagttgctttaaaaactaatttaatgtgttattttcttagaaatttatatctttattatagaaattttaaataatacatgtagactaaagaggaaaacattatcaatccccttcatcactcatgttatgcagattttcagtctttcagatgtaggcatctatctttaaaatgtctttgttatagcttaaggattacttcccggagagaccttaattatctaattaggtttggcctattagaatagaaatctcattatgcattacattctgtaagtttttggtgtacttttaaatttttctctctcacaccataaagaaaaactccacgagctgggactgtatgttttctatttattattttattctcagtatcttgtatagcagttcacataaatgtatgtccaattatttcttccacaaagaattatcaagtgtttttaattggcataaaaaagaaaggaaacaaaaacaaacgaaaataccagaaaaccctcaggttaatagttgatatactgcattacaattctagaatcatacctttttatactgttgaatattttcacatataaacatgatctgtctttttataaacatggtctttctatttactcaatgcatttttcatccctccataaagttaattttcttcatctaagtcctacacatttctacttacgtatttcgtctcttgttgctacttgctatggtctgaatgcttgtgtccctccaaaattcatgttgaaatctaatctccaatgttggtattaagaggtgggggggtctttgggagggtactaggtcatgagggcagaaccttcatgaatgggattagtgttcttacaaaagaggactgagggagcttgtttttctcttctgatatgtgagaaaacatggtgtaacttttcctctaggactttatgtttttaattattcttttccttgaagtacttttgacaccttagacagaaaaatgaactaagactgctggccatgatggctcacaacatacctgaatcccggcactttcggaggccgaggtgggtggatcacttgagcccaggagtttgagaccagcctgggtaacacaggaaaaccctgtcactacaaaaaagacgtattgtcatcagacaatacatctgctgacaccttgatcttggacttcccagccaccagaactgcgagcaatagattgctgttgtttatatattactcagtctaaggcatgttgttatacaagctcgattgaactaaggcactacttttatcaggactatttgccattaaatttttagaacaatttttaaataaattagcataaaaaattcacttctatgcaattttttgttggtcgctaatctctttagttatttatgaaagtttttcaatgggttctcttgagttttcctggcagcacataatataatacgcacatgatgatactttttatcaccttctttcaaatatttatgtgacctttatttttcctgattctgcattggccagcatattgtgagtaatttaaggtaagagtgagtatagtgatggtccttgtctttttcatacttcaatggcatcattccttggattctatttttaagaaaaatagttctgctgctttgagacagattttaaaaatcatgttcagaaatttttaaaatttgtttactaatagtttttatgagaaaatattacattttctcagtggcttattctgtgaaatctgtgaagatgatcttctagagttttttcttttgattttgttactattttcaaaattaggttagtgtattgaattatctttttattcctcgaatacattctcctcttttgctattatgattaaaaatattttattactttctattggctgacattatgtttgtgttttttgtatctattttcttagggcaaactgtcatagagttccctcagtgagggttgttataagcattttgctggattcgagtaacatgaggcagtacataacttgtctgagaagcttaaagctcttgtttccttcattgtcatttagttcactctctgcccacgtgttatacacttacgtttcttctaatttcagctcctaaatacttaatacctctttaaaaattctccttgctgccttttgatcttaattgactagaaaacaactttcatatttagtttagtctaaatcagatttatagaaacttcatcaaaaagcaataaacccatattaacaaaataaaaaatacaagaaggttctaaaaacattgaaaaatactgtctgaaagtggtgagtataatcaaaattggattaatgtctttatgctgccatttattagccttgagacattgggaaaattatttaacctattacctcagtttgcatatttgcaaaatgttacttaacagtgcctagttatagttgtgctgtgaggtttaaatgagataaggaatataaagcgtgtagcaaagtgcttggtacatgggaaccactctggagaagttaactcatattactatacctggactaaatatatttgctggtttgttttttaattactgtatcaataagaagaaaaacagaactggtatagaaaaaaataaactatgtaattcaatgttataaagccaactaattaagaataaattgtggcagataatagaattatatatagaacataagctccaagataaagattcaaattatttacagataattacatttaaataatcaatgtcaaattttccacttatatgtgttgtgtgtatattattgtactctgaaatataaatttggcatttctgacaagattttgttgttcttaactttttaaggctgaaggcattttaatatcgctatttttaattttttaacttaaagattttcataaaaattggttactataaagttgtattagctaatttacaatgtattgtattattgacacaaatttttagactttgctgttaaattatgagtgtattgccatctagccaggctaacattttataattttctctaaaattataatgacagccagtaacatggttatgttcattcttaataaattaatgatgctgaagagtcaagattgagagtgcaaccaaaaaccaataagttttatattaataaatgacacacagggtcttagaaaaagaggtatcataactttcatttggaaaaatagatttaaaaacatatttactaaaatcttgctttactgggggtgaaaagaatcagagatttccaaaagtaaaatcagtatttatatacccacatgcttacaataatctagatcaatatatttctatctttaatgtgtaacgtttcccccaggactttatattttttttattattttgcttgaagtgtttttatggcttaaatagaaaaatgagctaagactgttgggtgcagtggctttcacctataatcctaacattttgggaggccaaggcaggtgaatcacttgagcccaggagatcaagaccagcctgggcaacatgcgaaaccctgtatctacaaaaaatttaaaaaattagctgggtgtagtgacccatgcctgtagtctcaggtacttgagaggctgaagtgggaggatcacctgagcctggggaagttgagactgtagtgagccatgactgcgccactgcattccagcctggtgacaggcgtgaagagtgagagctgtctccaaagaaaagaaaagaaaagaactaaagaaaaaggaaccaagactttaaaaagatacacatagatgttttcaaactgtgggtttactaagatgaaagactgcttaaaccttttctaagaacaatttggttatttgttcatttcctaattgcatatatttgcccaaataagacccaagaaacgccctgtgccactaccgctccatctataacaacgcttcttgtcaattaaatgactttttccaaactgatgtttgcttattctttcctttatttattgtcatttaatacttttaaggcttgagaatttagatttttttctgtctacttttcatttttgaaggttttgagttgagacttcacagaaaactgaatacaaaggcacttctattacttcctgatcaaagcatcatctgaaaattagctacaattaaatttcaaatacaaatacagagaaaagtcaatctaatattatctttattatccaaaaggaaactagaaaggcctttacaacagatacaaataagacaattaaaaactaagttctatacttctctgaactgcctggtaattgctctcttttgacaaagtatctttctttattttgccatttgaggggctctctgttattttttccttattagttgttcttccttctagcttacatggcttacattcctaggctgtgtcccctcagccctttcacagggtctttctgtacccccaagtaattagcatagataatttgcaaataatgacatggaaaatagacacaaaatgtaaagattttatgtgatgatttattttatgacacgatcccatccagccgcacatattacctgcacaacttattcccatatgtaatgcactgtatttttccccagtttcattgctttaggagagattaaccagactgtgttaacaaagaacatttccatgtaggatgcacctgtacaaacgtgtgcaaatatttcctcattccacagttcattggtgttctgattcgtttaggtgctaaagttttaattcacataaaattcctaagtaagcagttctaaaattttgattttgacttgtcttaaaatatttctaagtaagcagttccaaaattttgaaattttgattttttaaaaatttttttggcccaacttaactgaaaaagagaaggaagaatagtaaatcctcctgaatctatcagcaatggagaggacagtagggtctaattttcatttatgctgtctgtcaggttgatggattagcttttattatacatgggttatgtgccaaacaatgtcttttgatttggattcaaggaaaacagcaggaatcttgaatgatgagagttctgaaagagttgttatttctggtcctttgatagaagtaaagagagactcatagctaaagtaacaccaaagtctcaaaatcaacttcacatgtagtttactcattgggtgagacacaatatgaagagtcaaagctagtcatgattcagtggagtttgacaaaatttctctgtgtccacttagctaaaagccttctttctctgttcccaggtgctgagatgtctatgcaggcaagtctgaggttagcctcccagagtttcggggaaaagcacacaggcattcctgaacactctgagaggtgcagaaaagtggctgagcagacagacacaaggtctggcatggaggcagaggatcacagcggagcatggacctaacagctggatgccgtgtggtgatatcactatcagcagaagatgcaacaagaccggggccactgctcaaggccagagaaacaggtttgtaggggccagtgggtcagcggtgaccatagaagacagtcttctctactttgatagcaaaacaatgcgtaaggcacctgaggaactcagattacaaccagggagaagaaaatcagaggtacaaggtgggatgcatcctgaattggtagaggagataccccagagtgttctaccagagttgacagaattaccttgaataaataagaagaaggtattttattaccaacagtctcatgggctaagtttaagtacagaggaataaagttatatctttacacacttgggtgtgtgacaatgtaaaatgtcaacattatacttcccaatggactatgccatgcagaaggcagaaagaagtcaaaagcctgttcttttttttcccattccatagtaaatagcagaaattattccctttgttaatctaagcatacaccagtctgtaggttcataatgagaaataactttttgttctttgatttttttaaacaaaatatagaatttataagacaaaccctttttggtttgtgttttattccaccttcttttagctagatttgaatgaaagcaaaataaagctatgtattgaataaatatgttaactccacagtatttttgaatatatatttttcatggtatagttccaactttcattggtgatattgatatgaaagtcagatttactgagaggtaatgttcagccttggaagcatcaccaaaatgtgtatataaggcctttgtccactaatgagtgtccttttatgtgactggttttgtaaagccttacactgtgaatggaccgtcaatcaactcgcagctgcactgaggccttcggatggctgtatccatggcaacgtgccaaaaatggcggcgcaaattaatccatttgtgtgaaattctcagtgagagtccactttcatctttcagaaactactgttaggaagtctgatgataatgtaaaatactaagcaaaagcaaaatagtgatggactatccacaggatcttctccctgtaaacagtgggacttcttttcctttttatctgctagagatgacagagcagagttggggatgtaatattaccaccataatgttctttttacaaaaaaagttacattaatttaatgttcacatataggcttctttttcaccttctctcacaatgctatctaatcagcctggaaaataagtacaatgatttacacagtggtacaaaattaaaagtaatcttttatcttgatgctttattgctaatagtatttgtatagcatatagcatatagcatgagaggtacttccagcatcgaatctgaaattaattgttagcttcctctgttatgtgaacagaagcagctaagtctttgtctcttagaaaggttctttaaaaatcatcattctttgtcttagatcatgcattatccctacatctacacaagtttgcttttcaaatgccatatcttaaaaaaacatattttgcctctgttcggataaatttacttaaaacaaaattgcaaattgtattgttaaaattatttgatgaaaaggtaacttttcacaaactaaacatgtagggcagatactgccttttattttagaatttacattcattaatcaaagatatcctagtgaaagcataagtgatgtgccttatgtctacttgttactcctgtcttggggacttgagctgtatttttacacacagaacaaaaggattattttctcttacattgttctcagctttctaaagtcatcagctactttgagaatctaataaaagttctagacacctatgagaaatacacatatgtatgctgtacaaatttccttgcagtttcagatgatccatggactacaggttaagaagatgttggtcaggccaggctcagtggctcatgcctgtaatcccagcactttgggaggctgaggcaggcagatcaactgaggtcaggagttcgagaccagcctggctaacatggcaaaaccccgtctctactaaaaatacaaaaattagccaggcctggttgtgcacacttgtaatcccaactactcaggaggctgaggcaggagaatcgcttgaacccaggaggcggaggttgcagagcaccgagatcatgccattgcactccagcctgggtgacagagccagagtctgtctcaaaaacaaagcaaaactatgttggtcaaattggtgttgaaaattttctctaaaacattgaatggagacgtccagtttcagtcccaacacttaaagagcttggaagttgtcacttccatacttaaaacaagaaaaaattgaacaaaggaaaatcaatggcttttcttggccttagtagagaactggatttgcagggcaaattgctactttgaaaaccagagaaagcagtaagtctagagagtcacaggtgagatctatttacacagagcagaagcagctagatccataagctgggaggaacactgaaatggcatttctaatgaattgctggaggccaagagtagactaacttgagagtgagaaactcctgggggctacaatctgaggaaactcccaaactgtcctaggtttacttctagaaattttgtcagcttctcatgatgataatccaaaaaaattcctgttacagttttggcaggggaaggggaagagaaaacattgtgaaatactcccagactgttctgtataaagcagacctagtctccaggagaaaaaaactttacctaagtcttatcccacagagaaggactttcctcctactcttactctttctagccttcggtctcatgtcagttgggaaaacaagatatatcactggaaaaacacttgtgaaggtcacagcccagagatgcagacagattgagatttaatcataagattatagaatgcttcccccacaacacacctgaccaccgcaccaacataatatatgaatgaataataagaatgaattacagctgaaagagttggaagacacacagtctgtctaaggaagggtttttagaggagcccaaagcaagaggagagacaaaatcaaggataatagctgcagcctctggcaccagaacaacagcaaacattaaacaaagcccagcttctagccacatgaatgtaaatcttcacattaaaggcccatttacctcagttctaattacccaatgcgtcaaattgtaaagcatgataaatggaagaaaaccccataatctgaagaaaccatgtaagcattagaaccagactcagatagaacacaagtgttggaattgtaaggcaagaaaatttacataactatggtaaagaacattcaagaaaagttaaataatgtttgaagagaaggactccacttacaacactaggcagatcattgaggtagaaaataaacaaagaaactctggacttaaactggactctagaccaaatggacctaatagacatttatagaacatgctaccaacaactgtaaatatatatttttttcatctgtgcatagaacatcctccagaattgaccataaagcaagtgtcaacaaactggaaaaaattgaaattatatcaagtgtcttttcagaccacagtggaatacaattagaaatcaaaaccaagagaaactcttagaattatacaaatacatggaaactaaacaacttgctctggaatgacttttaggtaaacaataaaattagggcagaaataaaaaattatctaagatggatgaaaatggagacacaacatacccaaacctctgtgaaggcaatgcaaggaggaaaatttatagcagtaaatgcctatatcagaaagataagaaaatatcaaattaaaaacctaacatcacacataaaggagctagaaaaacaagaacaaaccaaacacaaagctagcagaagaaaagaaataacaaaatgagagaaaaactaaatgagattgagacccccaaaaatactacagacgataaatgaaataaaaagttaattccttgaaagaataaacaaaattggtagactgctaggtagattaaccaagaaaacaagagggaagattcaaataagcacaatcagaaatgataaaggtgaccttataactgatatcacagaagtacaaaagattattagagactgctatgaatatctttatgctcctgaactagaaaacctagaggaactggaaaaattcctggaaacatacaacctcccctgattgaaccaggaagaaataaaaatcctcaacagaccaataatgagtaataaaatcaaatcagtaataaagtcttctaacaaaaataacaacaacaaaaaaagcccaggaccagagagattcatagctaaattttaccagatacacaaagaagagctggtaccaatattactgaaactatttcaaaaaaccgaagatgagggattcctccttaaagcattttatgaaactagtatcaccctgctaccaaaatcaaacaagaacacaacaaaaaaagaaaactacaggccaatatccctggtgcatacaactggaaaaagcctcaatgcaataccaacaaatcccatccaacagcatatcaagaagataactgatcactatccagtgggttttaacccggggatgcaaaaatggttcaacacacacagatctataaatatgattcaccatgttaacagaactgaaaacagaaaccatatgattatctcaatagatgtggaaaaaaactgataaaatgcaacaccccttcatgataaaaaacctcaacaaactagacatcgaaggaacatacctctaagtaataagagccacttaggacaaagttgaaagcattccccctatgagctaaaacaggacaagaaggtacactctcaccactcttgttcaacatagaagtgacaatcctaggagtgaaaatccacagtaatcaggcaacagaaagaaatatatggcatccaaattggaaaagaggaagtcaaattatctttgtttgctgatggcatgattgtatatctataaaacccataaaaccactccaaaagactcctagacttgataaacaacttcagtaaaccttcagggtataaaatcagtgtacaaaataagtagcatttctaaataccaataacagtaaagctgagaatccaatcgggaactcaatcccatttacaatagccacaaaagtgtatctaggagcatatttacccaatgaggtgaacggtctctacaaggagaactaaaagaatcaatataattaaaatgtccatatttcccaaagcaatttatggattcagtgcaattcctatcaaagtactaacatcacttttcacagaattagaagaaacaatcttgaagttcacacggaataaaagaagagcctggaatagccaaagtaatcctaagcaaaaagaacaaatctggggacatcacattacctgacttcaaattattttacaaggctatagtaactaaaacattatggtactttgacaaaagtagacacatagatcaatggaacagaatagaaaacccagaaataaaaccacattcctacaaccaattgatcttcaacaaagtcaacgaaaataagcaatggggaaaggactccccattcaacaaatggtgctgtgaaaattggctagccatatgtagaagaatgaaactggacacctatctctcaccatatagaaaaattaattcaagatggattaaagatttaaacatcagacctgataatataaaaaatctagacaaaaacttagaaaaaaaaacacttttggacattgacctaggcaaatgatttatgactaagacctcaaaagttaatgcaacaaaaacaaaaaccggcaaatagaacttaaactaaaaagcttctgcacaccaaaaatataatcaccagagtagacagacaatgaacagaatgggagaaaatatttgcaaattatgttttgaacaaagaactaatacccagaatctataaggagctcaaacagttcagaaagaaaaaatacaacctcattaaaaagtgggtaaaggcaaaaagtcatttctcaaaagaagacatacaaaaagccaaaaaacaaatgaaaaaatgttcaacatcattcatcatcagagaaatgaaaattaaaaccacaatgagataccatctcacatctgtcagaatggctattattaaaaagtcaaaaaacaatagacattggcgtggatacagagaaaatggactgtttatacactgttggtgggaacctaaattagtttaatttcaatggaaaaaggtatgaaaatttatcaaagaactaaaaattgagctaccattcgactcaggaatcccaaaggaaaaaaaaatcatacataaaaaaaacacctggactcttacgtttattacagcactattcaaattagcagtgttatggaaccaacctgtgtccatcaacaattgattggataaagaaaatgtactatatatacaccatggaatactatacagccataaaaagaataaaatcatgtcttttgcagcagcatggatggaactggagtccactatcctagaatatataactcagaaacagaaaatcaaatatcacatgttctcacctataagtgggagctaaacaataggtacacatagacataaaaatagaaataaatgacaatagggactctaaaaagggggaagtctcgaggggagtgaagtttgaaaaattatctattaggtacaatgttcattatttgggtgatggatatactagaagccccaaattcaccattatgcaacatatgcatgtaacaaacatacatgcacctcctaaatctaaactaaaataaaaaatttaaaaagagaaaatactagaaaatttaaaaagtaattgtaacataattgaagaatacctttgacaggctcatcagcagaccagacacagctgaggaaagaatcactaaaatcatctgaagagagatcaatagaaacattccaactgaaatacataggaaacaataatgaaaaaagtggaaaagaactcagataaattaccaagcttataatacagatgtaattggagtactggaaggagaagaatgaaagtagcagcagaaatatttgaaatacttataaccaagaacattctaaaattacgaggtataaaaccacagatccaggaagccagagaacaaaaagcaggataataaaacacacacacaaacaacaacaaaaagcaatgacaccaggtatatcatattcaaactgcaaaaaacaaagagaaaatcttaagagaagccagagggagaaaaatcaccttatttatatagaaacaagaacaagatttctagtggagttactgtcagaaactatgcaagcaagaagagagtggtgagaaatatttaaagtattgaaagaaaagaactcactaactagatttcaatatacagtgaaattatcctttaaaacggaaggagaacaaaaaccttctcaaatatacaaaaaactgagaaactttgccagaggccttccctaaaagaaatgttagaaaaagttcttcgggaagaatgaaaattatataagtgagaaactcagatccacataaagaaacaaatagaattagagaagaaataaatgaacacaaaataatgtcactttttaaactcttaattgacttaaaagaaaatgtttatataaagtaatggcattaacaatgggtttgtgattgtgaattatggataaatcaaataaatgacagtaacataatagaagacaggaggaaggaaatagaaatactccaagggaatggcactacaattgaagcagtagagtgttacctgaaggttgacttagattaaagatatattggaaaatgtagggcaaccactaaaaactcttaatgaaagaagtataattgatatgacataattaaaatagaattttataaaatattcaattaaaactacagaaggcagaaatagagaggggaaggaaaaaataaagaataagaaatagttgcaaatctggtagatattaaaccaaatgtttttatagtcacttttaatgttaactgtcttaatatacaaattaaaagtcagagaatatcaaaatggggttagagaaaagacctaattatatattttctataggaaatccaacttaagcataattcaggttataaaaagcaaaaaaggtataccttactaacgctaataaaaaaaggatgaagtagctgtatcagtttaacaaaaagcagaagagggaaaattatcaaaggttaaagagaagaattacataatgatagaactgttaattttccaagaagacacaacaatccttaaagcatattcacctaataataggtgtcaaaatacataaggaaaaacttatggaactgaaaggaaaagaaacaaatccactgccctagttggagatttcaacactcctctttcaataattgatagattgagaattagaaaattgataaggatacagttgactttaagtgttatgagaatagtattctcctaataccaaaatcagataaaggtagtacaagaacagaaaactaaagacaaatatctatcaacatagatgcaaaaatcctcaacaaaatattagcaaatcaagctcaagaatgcatgaaaataattttacaccacaattaagtgggattcattccaggtatgcgaggctgatttaaaacttgaaatcaatcatgtaatccaccacatctctatcctaaaagagacaaagcatgtaatcatatcaactgatgtagaaagagcatttgaaaaaaatccaacacccattcgttttaaaatctcacagcaaattagcaatagagggaaacatcgttaacttaataaagatcatctacaagaaatcaacagctacacatagacatagaaatagggactagatgttttctcctaaaacctggaataaggcaaggatgtcctttctcactacttctattcaacatcatactggaagtcttagctactgtactacaacaggaattgtaatttgtgcagattgaaaaggaagaaatgaaatggtttttattgacagatggcaaaaaaattatctatgtagaaaattcgaacaaatctacaaataaaaaatttcctcaaactaacaagtaagtataggaaggtcacaggatacaagattaatatacagaagtcaattgtttttctatatacctgcagcaaacaattggaatttgaaattaaaacaatacactttgcaatagcatcccccaagatgacatacttagatataaatctagatgcatatgtacagtatctatatgtgggaaagtacaaaactctgatgaaatcaattttaaaacatctaaataaatggaagtattttccttttacctgaatcagtagagtcaaaatgttaagatgccagttcttctgaaattaatgaagagattcaatgcaatcccaaccacaataacagcttagctcttttatagatgttaaaaaacaaattctaaattttatatggaaagtcaaaagacctagaatagtcaacacaatactgaagaaaatgaacaaagttggaagacacactacccaatttcaagacttattgtaaagcaagagtaatcaagatagtgtagtactgatgaaagaacagagaatttatcagtggaacagaatcaaatgatctctgaccaagaagaaatggcaatttaatggagaaaggatagaattttcaactaatggtgctaggaaaattgtacatcccagaaaaaatgaacctagacacagaccttacacatgacaatatatcatagacttaaatttaaaatggaccactataaaacttttagaactgataaataagtttagtaaagtttcaggatacaaaatcaatgcaaagaatcagtagcatttctatataccaataacattcaaactgagagccaaatcaagaacacaatcctatttacaatagccacacagaaaaatgaaatacctaagaaaacagctaaccaagaagatgaaagtgctctacaaggagaattataaaacactgctgaaagaaatcagagatgacacaaacaaatgaaaaaaaatcccatgctcatagatagaaataatcaatattgttaaaatggccatagtgctgaaaacaatgtacagtttcagtgctattgctatcagtacccaatgtctttttttcacagatttaaaaagacattattctaaaattcaaatggagccaaaaaagaggctggaatagccaaagccatcctaagcaaaaagaacaaatctggaggcatcacattacctgccttcgaaatatactacaaggctactgcaactaaaacagtataatcctggtacaaaaacaaacatgtagacaagtggaacagaatagagaacacagaaattaagccacacacctgtaagcgtcagatcttcaacaaagtcaacaaaaataagcaatatagaaagactccatattcaataaatggtgctgggacaactggctagtcatatgcagagaatgaaatggcacccctacctatcaccatgtataaaagttaacgcaaaatggattacagacttaaatgtttgaccttaaactataaaaatcctagaagaaaacttataaagtaccgttttcaatatcagccttggcaaataatttatggccaagtcctcaaaagcaattgcaacaaaaacaaaaattgacaaatgggacttaattaaactaaagagattctgcacagcgaaagacactatcaacagagacaacctataggattaaagaaaatattagcaaactatgcatccaacaaaggtctaatatccagaatctataaggaacttacaaacaaatcaacaagcaaaaagcaactgcattaaaaaatgggccaaagacataacagacacttctcaaaggaagacatacatgcagctaacaaatatataaaaatgcttatcagtactaatcagagaaattcaaatcaaaaccacaatgagataccatttcacaccagtcaaaaaccaccttcagtaaaaagtataaaaacaacagatgctgatgaggctgtggagaaagggaaacatttatgcactgctggtgagaatgtaaattagtccactcactgtgcagagcagtttggagatttctcaaagaacgaaaagctgcattaccattcaacctagcaattccataactatgtatgtggccaaaggaaaagaatttattctaccaaaaagacacatgcatctgtatgttcatcgcagcactattcacaatagcaaagacacgaaatcaacccaggtgcccatcaactctgaattggatacgaaaatatggtacatataggccaggcgcggtggctcacgcctataatcctagcactttgggaggccgaggcggggggatcacgaggtcaggagatcgagaccatcctggctaacacggtgaaaccctgtctctactaaaaaattaaaaaaattagcctggcgtggtggcaggtgcctgtagtcccagctactggggaggctgaggcgggagaatggcatgaacctgggaggcggagcttgcagtgagctgagatcgcgccaccgcactccagcctgggccacagagtgagactctgtctcaaaaaaaaaaaaaaaaaaaaaaagaaaaaaaaaagaaaagaaaatatggtacatatacaccctggaatactacgtagccatgagaaagaatgaaatcatgtactttgcagcaatgtggatgcaactggtggtcattatacttagcgaatcaatgcggaaacagaaaaccaaatactgcatgttctcacttacaagtgggaactaaatattgaatacacaggacaccaagatgagaacaatagacaccgggacatgcaagacggaggagggagaagaggggaccaagggctgaaaaactatctattgggtactactatgctcactacctgggagatggattgtactgcaaacctcagcatcacataatatgcctttgtaacaaatctgcacacatacaccctgaacctataataaaaattttaaaaaagacatagcatgaatttgacatgacttgcatctggtgatgatttttagtgatgacagcaaaagcacgatgaaagaaaaatcggtatgttggactacattaaaattaaaaactgtttttctccattaaagaaactgttaagagaataaaaaggcaagccagagattgggagaaaatatttgcaaaacacgtatctgataaagaacttgtgtccaaaatatacaaagaaatcttaacactgaacaaaaggaaaacaaacaactcaattaaaaaatgggcaaatgatctgaaaagacaccttattaaatactacaaatggaaaataatcatatgaaaagatgctaaacatttctcattagagaattacaaattaaaacaacaatgagatttttttttctttttttttttaagacgtagtctcgctctgtcgcccaggctggagtgcagtggcgcgatctcggctcactgcaagctcaacctcccgggttcacgccattctcctgcctcagcctccggagtagctgggactacaggtgcccgccaccacgcccggctaattttttgtatttttagtagagacggggtttcatcgtgttagccaggatggtctggatctcctgacctcgtgatccgcccgcctcggcctcccaaagtgctgggattacaggcgtgagccaccgcgcccggcccagcatatgtattttttaaaagctaggtaattatccacctgacttggaaatgtatgttcttacaaattgggggagagtggaacatctcttttgcagaagaattccaaatattttttgtagatactcaaccgtctagaaagtggagtataattcccaactccttacatgtgggctgaacatagtgacttccttctaaagactacagtgtgaaaacgcgggaaaaagactaagagacctgacaaacacctcagccagttgatctttgtcaacatcgaaattgactggtcatgttgatgatatatacctttaatatgtgatgaaaatggcattttacctctggtatcctcttccccaaacccatacccctgtctaatcatgatcaaacaaatctcaatagaaattctacaaaatgcctgaccagtactcctcaaaaactgccaaggccttgaaaggctgacacaaggtaaaacgaggaaaggaaaaacaaggaatggctgagagaccatcacaggcaagagttgcctaagacgacataccgactaaatgtgatatggtttcttgagtgggaacatttaacagaaaaagcatataccgtaaaaacctaggaaaactgaattaagtacggatttagtttgttttaaaaattcagtgataaaatgcttctctctacttgccattatttctttttggagttctaggtatttctttttggagttctaggtatttctttcacaccctagagcagcggtccccaacctttgtggcaccagggaccagtttcttggaagacaattttcccccagatgtgggagcaggaggatggtttcgggatgaaactgctccccctcagatcatgaggcattattagattctcataaggagtgcacagcctagatcttttgcaggtacagttcacaatagagttcgcgttcctatgagaatctaatgctgatctgacgggaggtggagtcgaggcagcaatgctcacctgccttctgctcacctcttgctgtgtggcccggtttctaggggttggggactcctgccctagaaggttctcagagattaggtatgggagctttgtaggctgatcttgactattcccaagtatcactgcattatgttcttaatacttataaaacctatattttattaattaagcatttattctattctcaaaattttactaaattgagggtatataaaggaaggcaaaataaaagtttctgtcctaatggaatttaaagtcttaggactgaacagccatgtagcagctggacaatatagtttttgttttcacctctcatctgaaggcatgaaaacttaattttttagttacatttgcttaaagatattagaaccaaaagtactgtaatacttctcaccttaaaacaaaatgaaacagaaattacttatcaggacctcagatcgccttgcaaccaccccctcttttctctgttccctcttacactgatactgctgaagagttgcctacaggtgttgcaaattctttataaccaatttattctccaaatctctttaatcttgctctgagcccttcactcagtggaaactgccattgttaaaagtctaaaactaatattcacgttggttaatctgaagttaatttctgttttcacagtgttcctctttatcaacagtaaaacttttgactactcttcctttttgaaatactgttacctcattagctcctcctcggccttcttccctaacagctccttttctgcctcagatttaatcttccttacatagttattaatgcatttaccttcttctctctttgttctctccctacacgattttattaactccatcattttatgctacatccataggctgttgatctccaagtcttgctcaggttcctcttctaggcatcagattcccatttttcactccccacttgacctttgctttggaaattttacgaattgcagacaattcatctcaaacggaacttgtctttcatcctagttttctctatttccagtaaatggcatcactatctacctattgccttgtctggaaatgaggaattcatatttcatttagcatttcctttactcctgaaattcagtccagcattaatgaaattccgtgtttctatatccaaaatatatcttcacctgttgaattctttctctctgtcatcatcacctttggccagtaactatcattctcacctggattcctgcaactatttttcaacaaatcttccctcaaaccattgtaagacattcataagctttaggcaggcttaattttagagtccataattcccatcatataaaccaaaccatattgaaatatttccatatcctacattaaaagcaatatttctgctgtggaatagtcttaaaatttgtttataaaattatttggtgtcaggattttatttaatatatgaccagctaagttatatattttatatgaccagctaagcaatagatgaaataaatataatatataaaaatatatatcatatttgataaaatttatgattatttattagaaattttcgtatcaatataatttttttataaatgaaaagaatctaaatctcaaacattttttagcttatgacatatttttgagttttatattttaaaatatatacttttagcctattatttgtataggattcaattgaacatttgtttattttgatgttgtgccaaacacataactctcttaagatagcacagcaaagaagtatcagaaccagaatttgaaaccaaggaatctggttccagaactgagctgttagttctcactgtcttctgaatactctacgaatatgagactgttggttttcagatgtcctgtggtccatatcacttgttcatatgtatttgttcactaggcacttctgccctagtatattaaacagaagacaagagaatgctgccaatgtaaaaagcatgccagctgcatatttcatataacttttagatagttaagattatcaagagtgttattaactaacagcaccccatttttggaggacaactaagaattatcacactttcaaaaagaagttttactttcagttagaaaataaataagttttggggacctaatgtatagcactgtgactacagttaatactacggtactgtattatttactggaaatttgacgaaagcctattttaagtgtcctcagctccctccccacaagactgtcccgtggtaaccatgggtgatgagggatatgttaattaatttgactctggtagtcactatacagtacatgcatatataaagtcacctagaatatatacaattttgtatgtcaatgataactcaataaatataggaaaaaaataccaaaaagttagttgaaaaattttgaatcagcatagtctgtgtgcccaacatgttatttaaaagtcagtaacttgcaagagcgatccctgaatgactgtgttttccccctcactcttgttggtatgaagatggtatttcagattagaagatgtttgagtgtaaatcattcatcagtgtcgttgccacatttggtgaaatgcgtttttccctcctttaataacaaatgctccaggttttgagttactctatgttttgcttcagtcatggtagagaattttaccgtgggatgctcgccagggaccatacttggttcatgcaacatagatgctagttttacaatttttggccctcatagtgatcatctttggcttttgaggtcaggcatagcattcttctagctatacttgtaacattttagaatccgctttcaagaaagaatgctcattagcaaggcatctgccatgttccggtaaggttgctttacaatgaattcctgagagctgcaaaatgtgagcaaaatgtctttatactggtaggcaatcagtgagaattaaataggtcttatttttcctttgccagatttaaagcaactgtaatgaaagttgcttagtattaaattctaaaggttttaaataacgtaaacttaaaggtaagagtccatgtctgtcaagcctccgatgatacgaaaaggaaggggaaagtgccatcattcccatgtggtcaaagataaaactgtagttttactggtttttatccagtcttctatcccttcttgtccacattgcttgctaaacagataaattctctgtaaaatgtgtcttgagaaactgaaacaactcagctattaaaaagaagtcagtagtgacaacagccactgatactaggtggagagagaattccatgacaggttatttcagtttagagagtacataaaatggcactctttaatcttcatgaagggcaattagaagaaactgcctcatggtaggaaaatgtacagaaatcagtcctttaagttgcatctaaaagagatttggaaaaactatagatgctgaaatatgtgttgctgtatatttcacttgggcagttttcttaaaactcactgaatacggtgggcaagaagtaatctaattttcactccacagtatgtccaactttataaatttagaagcccttaatgagaatttaaagaaattagagtaaataccttttactagattgaagaaagctgaaactggatctcttccttacaccttatacaaaaattaattcaagatggattaaagacttaaatgttagacctaaaaccataaaaaccttagaagaaaacctgagcaataccattcaggacatagacatgggcaaggacttcatgtctaaaacaccaaaagcaatggcaacaaaagccaaaattgacaaatgggatctaattaaactaaagagagtctgcacaacaaaagaaactaccatcagagtgaacaggcaatctacagaataggagaaaatttttcaatctacccatccgacaaagggctaatatccagaatctacaaataacttaaacaaatttacaagaaaaaaatcaaacaaccacatcaaaaagtgggcaaaggatatgaacagacacttctcaaaagaagacatttatgcaaccaacagacacttagaaaaatgctcatcatcactggccatcagagaaatgcaaatcaaaaccacaatgagataccatctcacaccaattagaatggcaatcattaaaaagtcaggaaacaacaggtgctggagaggatgtggagaaataggaacacttttacactgttggtgggactgtaaactagttcaaccattgcggaagtcagtgtggcgattcctcaaggatctagaactagaaataccatttgacctagccatctcattactgggtatatatccagaggattataaatcatgctgctgtaaagacacatgcacacgtatgtttattgcggcactattcacaatagcaaagacctggaaccaacccaaatgtccatcaatgatagactggattaagaaaatgtgtcacatacacactatggaatactatgcagccataaaaaaggatgagttcatgtcctttgtagggacatggatgaagctggaaaccatcattctcagcaaactattgcaaggacagaaaaccagactccgcatgttctcactcataggtgggaattgaacaatgagaacacatggacacaggaaggggaacatcgcacactatggcctgtcatggggtggggggaggggtgagggatagcattaggagatacacctaatgcaaatgagaagttaatgtgtgcagcacaccagcatggcacatgtatacatatgtaacaaacctgcaggttgtgcacatgtaccctagaacttaaagtataataaaataaataaataaatatggtaaaaaaattgaaaatgcaatacaatgaaataaattttacttgtctggaaactatagagtaagaatattttcatgtttacttcattatgatcttattttttacactacttggatttatgtaataaacaagtacatgctattgtttaatcaaaaaagaaactttcatgacatatcatagaaagtgtggattcaacttagttgcctctatttcataaatatagtatatctagaacgatgatttaaaaattgtatttcatttaatatttttgagtgtctaatattttctggtctctgccttttaaggaagaggtgtgtgagatctgtcctcccctctgtatagtgacacagacaaatagatgatgtttgtgctcattggtaattgctgcaagagacagaaagaattactgggtgtgtgagcaaagagaaacattttataattggaggaaaccaggaaaagcctcacagaggacttaggttttgaacttacaagtaaaatatttgaaagatgagtaggtgctcaaattatagaaatgaaggataggaatttttttttaaagaaatggcctcagaaaaaaaagctgtggatcttaaaaggtttatgtacttgggaactatgacaggaactttgctatgattagagctgcaagtagttaaaggttggagcacagaataatcctagaagcacctgacatagtaatatggaagattctttttagtttagctctttttgcagttttacatattgctttttaacctttgaacactgaccatccaataacccataggcagcagggaaaaatatattttttaatttccttccaatccttttcaaataattatttaaaaaaatcagggattataggccaggcgcggtgactcacgcctgtaatcccagcactttgggaggccgaggtgggcggatcacaaggtcaggagatccagaccatcctggctaacacgatgaaaccccatctctactaaaaatacaaaaaattagccgggagtggtggcgggcgcctgtagtcccagctactcaggaggctgaggcaggagaatggcgggaacccgggaggtggagtttgcagtgagcctagatcgcaccactgcaccccagcctgggcgacagagcaagacccactcaaaaaaaaaaaaaaaattcagagattataaacttagatggcaaaaaaagcaggcagataatgaaaatgaatgaagtaggccaggtgaaatatttagctttcctcttggtctaagagaaaagagcaagtgcaatggtaaatcacagcaaagactccgattaggtcctgagtgggcagtgctggaggcagtcactggacaacacttgccccattcacaggagctggcagctccatccattttaccctacacagttgcggtgcccatgttgccagatatcttgattttgcaagagaagccagaaataaggatttttctctgctatatcccaatttttaagtgctagtaaatccttcacattttttttttaaacagtatgtgggccaactttatagcacggccaaacaaaacaggctggggtccttatcagaccgttggcagccagttgaccattgctgttttacattgttgagatcatacaatatactcaatgtcctgctttttcccattaagattaaagcaccatagaattgttagaatttcaacatccactctttttagtatgagaatttaaaaatacactaaaaattcgagcatatagtaaagatatatgcatatattgaacacctatatttagtaatcattaatctatctttttttgttttgaacctataatttaaaaaataatactttattaaataaaacttttgcacttctcttcaattatattttcagcagttcatcactagaaataattattctaaagttaatatcttcatatttatgttttagtactattaataatttatatacataaataagagttattgtttgcagattgcaatttaaataagaggtattatactgaatgtttcatttggcaacttttttttttaactcaacactattctagagaaatctagccaagttggttatcaataggggtaaatcagtttaattttcatagctacagaaagcaaaaattcattatagagagtagcattgtataaatatatgtttatttattttctattgatggctatttaattttctcccatttttttcgcagaaattatgttgtattgaacatcttcctacatattccctttggcacatatatctaatttctctagagtgtatagttgaagaagtgggtttctaggttctagggggcctatgtcttcaactttactgaatgaaaattttaaaattttaattaagaatactaaaaattggcttccctaaatagttataccaattcacactttgccagttgtctgtgagttcctttcccccattttttgccagtatttggtattttccaaattggagcatctgtttatatgtttattggccatttgggtttcctcttctatagcatctctgtttatagcctttgaaagttttctcttttcacttgtatttttaaattttagtattcacagcttaataattttagttgtcaatatttcgtcagctatatgtttggcaatttttaaaattttaaagacttaatcagatttactcatctttttttcatttaaaatgtcatatcttatctaataaatctttcttttaaagaatgacaatactgtcctatattttaaaatatttcaattttgctttgtgcatttaagtctttagtttccctgggatttattttgcgtattgtattagggttctctagagggacagaactaataggatatatatttatataaagcagagtttattaagtattaactcacatgatcacaaggtcccacaataggccgtctgcaagctgtggagtgagcagagccagtccaagtcccaaaactgaaggactttgagtctgatgtttgaaggcagcaagcatccagcacaggagaaagatgtaggctgagaagctaggccagtctagtctttccacgtttttctgcctcttttatatcctggccacactggcagctgattagatagtgcccacccagatgaagggtaggtctgactttcccagcccactgactcaaatgttaatcccctttggtaatacactttcagacacacccaggatcaatactttgtatccttcaatccagtcaagttgacactccatattaaccatcacatctatggtgtgatgtaggtatttaatttttttccttattaacagtcaattgtttcagctctatttcttgcctaatcccatttcctattttcagttgctccctttctagaatatgtattgtatatggttccatgttcaaaaggcatgtttactttaaaagatacacattagcaagcatacagctttcgaagccatccaattcagggcattctctagtactagctcatgtatgcctggaacattgacaagtgatcaataaagtacagcaataagaaatttaaaaaataaaacttggtagatcaattctgaagacatcacagaggtatagcagtgaaagagattaagatgtcagccaattaaacagtttgtttcagtactttatccagtgtcccaagacctaaaattaattctttttctactgaaaaagggaaaatagttcttacctgtttgttctatgctaagagctttacaacatttcaaaatctatgctatcaaaagaagttcagtgaaatatttttatttaatacatttattgtttccattgcctattctaccactgcttcatagacatgtgaaaaatgttcatgccgatggttattgcctcagatgacgtaagactgccctagacaaagctactcataaggctggagtagagtcctgtaagagacagttttaaattgggttaacactggtaaagggacaaaaacattatctttagaactattaactcataaattctttcaattttggaatgttgccatgaagctttcttaatccaaaccctaaagatgccattgttctttattccattgtaggcttttttcttcttccttttcttctctcaatgacttgtaaattattgcctgcttcatctaattctggtcaatctagaccctgataactattcttgttgttcatcttctgagagaaatgataggggtcagaccagtctttctcatttagattatttccccgttctttccagttattgaaacacatataaagccaactaaactctgctcagttgaattcagattatcattttccagtcaacataagatatatacatatatattcattcttttatgctttaatcatttgatcaataaactgaagatgtttagattttttttttttttttttttgagatggagtctcgctctgtcgcccaggctggagtgcagtggcgggatctcggctcactgcaagctccgcctcccgggttcatgccattctcctgcctcagcctcccaagtagctgggactacaggcgcccgccactacgcccggctaattttttgtatttttagtagagacggggtttcactgttttagccgggatggtctcgatctcctgacctcgtgatccgcccgccttggcctcccaaagtgctgggattacaggcgtgagccaccgcgcctggcctgtttagatattttaattatcacttctaagtaagcttaatgtaagcctgcattctaaaaagcttacattaacaatttactgttattttaacaaaatatataattcagaaaaactcatgagtatctcaatagatgcagaaataccatttgtcaaagtttgacattcattcatgattaaagtctcaatacaataaaagtcatatatgacaagtccacagctaacatcataatcactgaagaacacctgaaagattttcttctaagatctgataaaaggcaagggtgcccactcttgccatttctttaacatactactggaaatcctaatcagagctattagacaagaaaaagaaataaaaggaatccaaatcagaaaggaagaagtaaaattaaatctatttgcagatgatatgatcagatacatagaaaaccctaaagactcaacaacaacaaaatgcctattagaataaacaagtttagtaaatttgcaggattaaaaaaatctacataaaaaaatcacatttctttttttttttcttgagatggggtctcactcttttgcccaggctggagtacagtggcgcaatcttggctcactgcaacctccacctcccaggttcaagcaattctcctgcctcagcctcctgagtagctgggactacaggcacacaccatcatgcccagctgagtttcgtatttttagtagagatggggtttcaccatgttggccaggatggtctcgatttcttgacttggtgattcgcctgccttggcctcccaaagtgcttagattacagatgtgagtcaaataagtcacatttccatacacaaacaatgaattattcaaaaaggaaatcaagaaaacaatattattcatagtagcaacaaaataatcaaatatttagaccaaagaggtataacctaaacaaaagaggtatactgaaaattataagacattgatgaaggatattaaagaagacataaataaatggaaagaaatttcatgttcatggattggaataattaataccattaaattgttcatattacccaaagtgatcagcagatttgatgtaacccctatgaaaaccaccatggtattctttactgaaactactcctcagattcgtatgggatatggaaccacaaaagacctcaattagccaaagctattttgagcaagaagaacaaaactggacacatcctagtctcggatttcaaaatctattacacagctacagtattcaaaacagtatgctcctggcataaaaacagttatgtagatcaaagataacggagaggccaggaataaatccacacatctatggtcaactgattttcaacaagaatgccaaaaacacatcatgtggaaagagagtctcttcggtaaacagtgatgggaaaaccagatagccatatgcagaggaattaaattgaacccttatctcataccatatacatgcatcatacaccatttacaaaaatcaactaaaaagacttaaagacctaaaatcataaaactaatggaagataatatacaaaaaagttttatgacactggtctaggcaatgatttttttggatatgacccccaaagcacaggaaacaaaagcaaaaatagacatataagaatgcaccaaactgaaaagcttctgcaccacaaaggaaacaataagcacaatgaaaagacaacctatgggatgagcaaacattttctcaaacagtatatatctgaaaagggactaatacgtaaagtacgtgagtaactcctgcaacttcatagtaaaaaagaaaaaaagcaacaaataacccaatgaaaaaataggttaaggacctgaacagacagttctcaaaagaaggcatgcaaattgctaacaggtatgggaaaagatgcttttgtgtctggaatttattccttcagtttggttcttggtctcgctaacttcaagaatgaagccacagaccctcacagtgagtgttacagttcttaaaaatgatgtgtctggaatttgttccttgagatgttcagatgtgtctggggtttcttccttccatgggtttgtggtctcgctgacttcatgagtgaagccacagaccttcacagtgagttttaaaactcttaaagatggtgtgtccggagttgtttgttcctccaggtgggtttgtggtctcgctgacttcaggagtgatgcgggagaccctcgcggtgagtgttacagctcataaagatagtacaaacctaaagagtgagcagcaacaagatttataaaagcgaaagaacaaagcttccacagtgcgtaaggagactccaggggattgctgctgctggctcaggtggccagcttttattcccttatttggccctgcccacatcctgctgattggtccattttacagagagctgattggtccattttacagagtgctgattggtccattttacagagtgctgattggtgcatttacagtcctttagttagacacagagtgctgattggtgtgtttttacagagtgctgattggtgcatttacaatcctttagctagacacagagtgctgattggtgcgtttttacagagtgctgattggtgcatttacaatcctttagctagacacagagttctgattggtgcgtttttacagagttctgattggtgcgtttacaatcctttagctagacacagactgctgattggtgcgtttttacagagtgctcattggtgtgtttacaatcctttagctagacacagagttccaattggtgcgtttttacagggtgctgattggtgcatttacaatcctttagctagacacagagcgctgattggtgcgtttacaatcctttagctaggcagaaaagttctccaagtactagacccaggaagtccagctggcttcatctctcactttcactactcaccacaaaagtgcaaatcaattccacaatgaaacatcacctcacacctgttaagatggctgtgatcagaaagacaaaagataacgtgttgtctggaatgtagagaaaaataaatttgtatatgctgttggtgggaatataaattgatacagctattatgtgaaaccatgtgaaactaaaaatggttccttcaaactagaactaaaaataggactaccaagggcccacagtcctgcaatgccacttctgagtatttatccaaaggaattgaaatcagtatctcgaagaaatacctgcactcctatgctcatttcagcactattaacaatagccaagatatggaaacaacctaaatattaatgaatgaataaagaagctgtagtatatatatacatataatattccatatattacacatatatatacacacacacacactctatggaatattattcagactttaaaaagaaagaaatcctgctatttgagacagcatggataaacctggaggacattatgcttagcgaaataagccagacatcgaaggataaatactgcatgatctcacttatatgtggaatctaaaaatgtcaaactcatagaactgaagagtagaatggtagctaccaggagctggggaaggggatgtgaggagatgttggttaagaggtgtaagttttagatatagaagataaataatctctggatatctaatgtacaacaatgtgaatatggttaacattatatacttgaaatttgataagagggtagatcttaagtcttctcaccacacacacacacacacacacacacacacacacacagacaaacacatggcacagtagctaaaggaagtgttagatatgctaatcagcttgattttggtaaccatttcacaatgtatatataaatataaaaacaccatattgtataccttgaatatatataacttttaattgtctattttttcaatgaagttgggggaaaaaagatgtagctccttcattgtttttttcccctccttaaattctcttttcactttcctcaggtgacagtctgggtcatttgaaagaaatacttttccatttgaggtcaataaaatatttttgcaccttttctttcctggttctgctctgcttctctaagcagtaaacttcacagtgatagacactctgggtgagctcacagctttttgaggggtatattcaattcaggaaactggtaggatttcctggatttggggcaggagacctggagaagtagatgggaggaaatcagggagcaaagtagcccggggcattggcctggactgagtgctgaaccaggggttttactggagtgcatttctctgcagtgcaactttgtatctgcagtgctgagattggcttcttgtaagcagaagcctgggtgcatggttttcattccgaagctatgtaagattttgatcttggcaagtgactgcagtttatgacagctttgtccacaggaaagtgtctgttttacagagagaactgcagaaaccagaccttcatggaacaaagcctttgtgaggttttagttttaaattaccagagccaggtttaggtaagcagtgccagattagctgtaacaaaatgtattctgcacgtagggtcacggagggggctgtgaagaagaaagcatcagcttcgtgtggctacacagtggctctagagtcaggcattgttgtgtgctctcaaattaaagatagacaatggattgcatgtgagggagtaatcatcccaaagacagcttgcttaggcttcagcaatagcaccatgaggcagtgcaaatagcttatatggcacaggtctgaaaaatactgtaagaagaatgtggatgctgataccattggggtgccagaaacattggactcggagggaaactgaaattaagcaatttttaatgcaatgcatgtgaaagaaaggcccctcaaataagaacaggtgactgtacttcctcctgtgtaaatttctaaacttttcaagatggcagcaatggcctcctttgctctgagagggaaggcagtaagcatatgtagattttaacctagggagatgatcaggatagactgccagaattttcctcttgctcagagagtcctccatgtaaagttaaagttcacagatcatggattctgggcagctgatgtagaatgactggccttctggaataactaaaacagattttcttcatataccttcctttatgcaggtcccacagagtgggcttggctttaatgcttgcctagagtaagcctgggattctgctatggtgttcatcaatgaaatatcatgggttctgggaatatgattttttatttggataattgtttttgagtctgaggattatctcattttctaaatgttataggtgtgaggtgatagctatgatacttatgaagaatcatgtgaatcccagtaactctggattccttacaagtgagcctcaggagagccttagcacagaactaatactatgacttctgaagccctgaaagaagagcattctttccagtgggaggcttcctagcatatatttactgaggaaatgacagcttcactgagaactcctctggctgaaacggggcagaatgaaattttggtagagataccttttgaattttagttttcttaaacttttaatttgtgaaggaagaagagaaagaagaagagaaagaggaataggaggaagaggaggaagaggaagaggaggaagaggaagaggaggaagagaaagaggaggaagaggaagaggaggaagagaaagaggaggaagaggaggaagaagaagaggaagaagaagaagaggaagaagaagaagaggaagaagaagaattattattatttcagccggttttttttttactttgcactttctgtaggccctaacaactaatttcattttttgacttaaatttttcctccatgttgattgagcagatttatattcaaatcagaggcatgttcattttactgttgtcatttgctatattgcagaaggtgactaatttgtcccagtttacctgggactgccctggttttaaaatggaaagccccacatttcagaaactgtcagtcccaggcaaactgaaacgattggttaccctttctgaaaggttatgctggaaaatgtggctgtacatactttggacataaaagagggaatgaccttttggtttgggaaacagattggatttgaagtgaatttactggacatactgttctgacccattccagagtcctgtttgggcaaaatgcggattttttttcttttttaaatgaaacacgtctggagaatatatgaatcagtatggtgtcaggaaatccacttgctgggggtgggtgggggcagtcttaatgggcagctatttccatcccatgtgcgagaaagccttgcttcagattggccatcagcttaatggtgaagccaaaaggattaagagaaccaaaagctggatcatgtttaaatgacacttcttttccaattttgtcgttctctttcacaaagaaagaactgtttgcatggcctttctccctgcactcactaacttctctctcaccctagatagaagcatttggaaggaaaaagtgcccatagccatcctggccctttacctgcatgtctggttagggtcacggctgctagcttaaagaaaatgtccagtgcttctcaaaaagtgctctgctgaaggcagcattagcactaccaatcttgataaaaatccacatctgggggccccaccaaaagtctactgagccagaatattggtgtaatgccagaatactgggcagtgtaatgatttgcgaatgtttaaggtgattcttatgcaggctaggtctaagatactgctctaggttgtggaagagctactgtgtgtacctgggaagttgcaatgttccaggcttgctggtgactaatgggataaatcaaattctgggactaatgggataaatctaattctcattagtattaggaagtcctcctccctgataacaattttttacccttttttatggaatgtagctaagttagcagaaagtgacctttttcaggccttgcttttataatattttgggtggaagcagagtgacatttagtctagggctaatgatttcctgcaactgaggcaagactcttttgagttctctcctgaaaaccctatgaattatgaagtttccattcgggctgatgagaataggctctgcctccagccccaggtatggttccttctaattccattggatgatctttccctggatttagagagcttcctcacacaaacaggatgttacttactgagctgaatatgaaaggcaatgctttgcagaacttgggagttctatctgtgtagcattctcctttctggtattatgccctgaaatgccagctgccttggcctctgggactcccagctctgtgttctcaatctgaagaatgctgggctcaaccggggctacccttccttttaccctggactggacactctcaggacagtaagctggagaaattagtgttaatttgttgccaactcttagagatttagtgcctgatgtccaatgatgtgaaaaccactatttcatatattttgccttttatacttgtgtcaggcagaaagttaaatttgttctctgttactctatcttgagctgacatggaagaactcttctgccattttaattataatggcagtgtcccattttatgcagacccagacttccatttgtagttttattttcccatattaaatttgcgataatttcattatatccctcctcaatatcctgcagggatttttatgtgaattgcatttaatttctagatttagtaagaattaatatctttaatctcatctatgaacaggatcaggactcacacttaacccaactctatggagcagcattcacattgcatgtggtaggggtaacacctgttaggattaggtaaatagaatggcaccaaacaaacagtacttatccgtataccatgatcttttatattttaaaaagaaatttcagccaggtgcaggggctcacgcctgtaatcctaacactttaggaggccgaggtgggcggatcacaaggtcaagagattgagaccatcctggccaacatggtgaaaccccgtctcttctaaaaatacaaaaattagctgggtgtggtggcacatgcctgtagtcccagctactagggtggctgaggcaggagagttgcttgaacccgggaggcagaggttgcagtgagctgagatcacgccattgcactccagcctggtgacagagtgagactctgtctcaaaaaaaaaaaaaaaaaaaaaaaaaaaaagattttttgtattttcttcaaaaattgtatgcatcctttaaatttaattgattgatattctatagtttttttgttcatcttattttctgtttcattatctacagttgctggtgcaaagggtcactattaattttagtaaaatgatcttgtatttggcaatctcacttattgtgaccactttcaagatataagatggacccttcactccaaatttggttcaaatgcctagactgatagtaccatatacacagcaagagaagatgaaatcaaggtctctggggaaagcaaggcaggctttatgagtagctccaacagggacagagaaagcaagggaaggaggctggctaggattttaatacttgtgtttaaggggtgggattgggttgaaggttctcacacatgggcaggggcttgcttggtttggatctcccaccagcacccaaggagggagtaccgggctttattgtatttcttaattatgcaatttaaatattattataaatgaaatatattaatttagcaattattacagaaataatatctataagtgggcacaagggaaagaggctgggggttaggcacaatgacaagtacactctgtcaggtgatggatttaaaagttagcctgatttattcactccacattgtagacatatagcaaaatgtcaccttgcaaccaattatttgacagttaagaataatactaaaaacagaagttgtcagcactcaaacatcaaaaattgcagttaaactgtttattgcattaattcaatctaaaagtttattttttgaaaaactcaggagtgcgtggaatttctttggcaatgacatcacttgaaataggacaattcaatctttttctaactaaatcaaatcacatttctatgtttccttgccctcaatcattatccaagatatccaataatgtattgtgcaataacagtgataactggtgtttctgatttgatcttgaccttaaagaaaaatgattaaaatttttttcgttgaatgtggtgatatttcgtgattcattctgcacatagtctacagcaaggtaagaaagttcccttctgtgtctatttgttagaattcttatcataaatgggtactgaattttatcaaacacatttcttttcagtatttagatggtaacatagttgttcgcatttagtcaattaagcagtgaattgcattggcaaattttctgctactaaatctctttatttaacataaaaataactaaattaatatattacacttcaaatattatttaagttgcataattaacaacttacttaggattttgatttcaaatgagataaattaatgttatttttgtgtgtgtgtttgtattatctgtattgttacgaaagctgtactaacctcatggattgataaagggaattctctttttccccctgtattctttatttctataagttagggattttttttgttgttctcaaatgttagtgaccaattacagaactcttatctggatttagaggtcattttggggtacgtgtaagcagtagacatttttaatttttatttccatttccttaataattattttgagttcaacttttctctttcttctttagattgttgacattttaaaagtcttttcagacatggcattctttttatttgaactttcaaatttaggggtgtgtagttatgtgcaataactttttaaatgttaaaaataactcttatatatgtcattatttattccattttctttttttcttttatttatctgtcttgctagagatttgtttatcttgttagttttttgaaagacaaagccttttgttttggcaatattttttagctccattcaaggaatggagttcattgtgtttctgaggtcaatgcacacatgagcactgagcctcacaagtctcctttgttcgtctgcctgtcttgccaggttccccagaaaacagggcctgaggaaaaggcatcgcactaaaatgttattaacatatgcaatctctaggaacagaagtcagaataaaggggaatgaggcaggaaaggaggaagaatccatatcaagggaggctgactggttgatcttgtagaatatatcttccaaggcgctgtataattggttatttctcaggacatttcatgtgggggaacaaaggaaagatctgatcccccggttcacatttcccatgggtcaaagatttatcctctgtggtgttacacccttccttgggttttgcaacattttgtttggctatgtgttgacaggagtttagagatgcgcatggtggacatgccacgaggaactagcaggctgtgcctgtgtgagggtggtcagtttgtcacacagtcaaactctgcagcagcaccaggggcagaacaaagtgacccaaagcccccaaactcgtaaggctgagaggacctgaagaggcaccaaagaggtgactgatgccctctctgcctttctctcatttacctatccatttgtttttattcttgtgaaatcacattctccctacctccttcagttggtgacatacttgatatacgccgctgaaagtatgtgtcataatgaaattgtgtttgtgcctgtgtgtatgtctatgaatttttagtttacatagatgactacaagtctttatcaactttttactattttccatttctttttcactttttctgtttagggctattttgttgttgcttagtatacatccagtattaaaactggctaagcctaatattcttccattcattatgttgtttgctgatgtttttgattaattgctaggttatttatagttctctgtgacagatcatagatttgactctagctgatttaagcagagaaagattttgtatttaaagaatgtattatctccaagaaagtcagacatccatacttggatactacataatcaggaagagatctataatgggaagtttctgacctcacccagcactgttgctgctgccactcggcacctatgtattttgagaccagatgctcggaaatctgccttagcttcctcagaagaaccatatctccaataccacaagcccatctctctaccattctatctccaagtctcgagttaagtatgtctgattggctcaaaccaggtctcacacagaatcctagctgtaataaaaatacagacaatgtagtttttagctttcttaccttgaaagttcaaagagttctactagaatggatttgaatagatgctaagtgagccaatttacagtatctaccaggagtactgaagtatcaatataaccaaacacgtttctattccgaacttttttaaaattataagtacgtagagagattcgtcaaatgctttttatgcatcatggccttaaaggttatttaaggccatgtgtgtgactgttacttgctaaggctttatgcaagaaagaatgagtatgcatgcacataagcgtaggttggaccacaaccctactttatctgctcaatgaccttgctcaatatgtagtttaggccccaaggagagggaaattattagaccatccatttctctaggtacattatgtcataagtcaagttcactaaaattaaatatttaagcatttaaaaatattctgtcatagtaatgccagtcttcaatatggtaagttacatggagaggatttctgaagttgaggtatcattacatttccagtcaactctacttaattgttgtgcatttatgtgtgtgtgagtgtattttctaattctttgttttcttcattcattggtttcttttgaaataagttgttgactactttcgatggtttgtgaacttttcataaacatcattgtaaatggttaataatgattatttctatttttttgcttttataaaatacactctaatatatttttgtacccaaagtaaaactattgggcgtcaaattttatttttgtaagacttgtaccaaggtacttccaccagcaatgtgtgagtgtgactgttttgctggacccctagcaggactgagttttcttatgaaattagcaaaaattcttgctaattaaaaggcaagaatagttatctagtttaaattttcattttttattaacaagattaaacatttttctgaatattgaaataccagtgttgtctcctttcttgctcttaaatttttgttttttatgaaaatctaacatatattcagagaagtgctcagactaataaaaatctataaagctctgcacctgacaacagaatccacattctcctcaagtgcacatgaataattgtccaggatcatgatatgttaggccataaaaaagtttaaaaaatgcataaagattgaaagcatacaaagtatgttttctgactacagtggaattaaattagaaatcatcaacagaagaaaatttgggaaatcaaaaatttgtagacattgggctgggcatggtggctcacgcctgtaatcccagcactttgggaggccaaggtgggtggatcaccagaggttaggagttcgagaccagcctggctaacatggtgaaaccctgtctctactaaaaatacaaaattagccaagtatgatggtgcgtacctgtaatcccagctacttgggaggctgaggcaggagaatcgcttgaacccgggtggcacaggttttagtaagccgagatcgggccactgcatgaactccagcctgggagatacagtgaaattccctctcaaaaaaaaaaaaaaaaaaaaaggaaaagaaaaaatgaaactaaaatgagaataacgaactaacccaacaaaagaaataataaatattagaatagaaactaataagatggagaatagaaaaatagtacagaaaacctctcttacactatatacaaaaattaactcaaaagtttgttctttgaaaaggttaacaacatcaacaaacttttaggtagactgatcaggcaaaaaaggagagaagacatttatcttgtatatagacaatcctaagtataataatacacacacatgcacacacacacaattatgaaatctaagaaatgagtttagcaaggttgcagaatataagatcaatgtaaaaaatcaattgcattcctgtatgttagcaatgaacaaaaataaaattaaacactcttctctctttatatattattaaatagattaaaatagactgggctcagtggctcatgcttgtatcctagcactttgggagattgaggtgggtggattgcttgaggccaggagttagagaccaacctggccaacatggcaaaaccctgtatctactaaaaattagctgagcatggtggcacacacctgtaatcccagctacttgggaggctaaggcacaagaatcgcttaaacccaggaggtagaggtttcagtaagctgagatcttgccatggcactccagcctgggaaacagagcgagaccctgtctcagaaaaaaaagaaaggattaaataattaggaaacaataaatcaaaagacctgcaagtcttatatatggaaaaatactaagcattgttgaaggaaatgaaagaagacctaaataaatggaaagtcatcctgtgttcatggattggaagattttatattattaacagagcaataatcttcaaattgatcacttgaattcacaaattgatatggattcaaagcagtccataccaaaattgcagctgcttttttttttttttttgcagaaattgacaaactgtttctaagatttatatcagaatgtaagggatccacaataatgaaaacaatgttgaaaatgcagcacaaagttagagaaattacagttcttgatttcaaagctggctacaaaactaagtaaatcaagactgtatagcactggcagaagcctaaacatatgtcaatggatagcgttgggagttcagaaataaacccatacatctatgatcaactgattttcaacacgaagcaagatcattcaatagggaaagaatagcctaacaaaagatactgatacaactggatatccacactgagagaatgaatattggtccctatctcacaccatatacaaaaattaacaaacaattttaatgtaaaacctaaagctataaaactcacagaagagagcacatatgtaaatttgtatgaccttggatttagcagtggcttcttagatatgacactaataatacaagcaacaaaacacaaaaatggataaactgaacttcattaaaattaaaaacttttgtcatttcaaatgacattaccaaaaaagtggaaaggcaacccacaaattagagaaaatacttgcaaattatataactgattaaaggtttgcatcagaatatgtaaagaacttttaatgactcaatactaaaaaacaataacccaattaaaaaatgactaatgatttgaatagacattttttccaaagggatttacaaatggccaagaagtatgtgaaaagatgctcacaattagtcaacagtgaactgcaaataaaagtgaatgtgagacaacacttcacacataccaggatgtctataatcaaaaagacagacaataaaaggtatttgtaagactgttgagaaattgggatcttctagtggaaatgtaaaatggtgctgccagttcagaaaatacagatggcccttgacttatgatggttcaacttgtaatttttggattttacaatggggttatccaggtgtaactccaacctaaatcaagaagcatctgtagtttggcaatttctcaaaaaattaaacagagaaccaacccagtaatttcactcctaaacatatacctaaaagaactgaaagcatagatccacacaaaaacttgtacacaaatgtttatagaagcattaatcctaacagccaacaaatagaaacaacctaaatatccgccaattgaatgagtgaacaaaaatgtggtctatccatacaatgaaaggccgttcagccattaaaaggaatgaagtactaatacatgctacaacatgcttgagccttgaaaacattattctaagtgaaagaggttggacacaaagggctacagattgcatgattccatctacctgaaatgttcacaatgggcaaatccatagggatagaaagtagccagggcctgggggtagggagagaattgacagtgtattagttttctatttctgctgtaacaaattattataaacttcatggcttaaaagagcacacatttattatcttacagctctggagtttcaaggtctgagataggtctgagtgggctaaagtcaacatgtcagcaggaccacattctagggagatccactttcttccctttaccatcttctaggggctgcattccttggtccgtggcccgctttgccatcattagatcacccatgactagtttagtctttttcccattgcaccactctggcactgactcttctgcttctccattttgcatttaatatttgtggtgattaccttgggcccacttggatagtccagaacaatcccttactttaaggtcactgactagtaatcttaattacatctgttattttaattctttaattccatgtaaagccacatattcacaagttccagggatcaggacatgggtgtctctgggaggctgttattctgcctatcacagggagtgactactaatgggtatgcggcttccttattaggggctaaaaatactctagaacaatatattaatagcagtcattattgtacaactttatgaatacaataaaacactaaattacttatttaaaagggtgaattttctgttatatgaagtatctttcaataagaagatgatatgcaaaataaaggcagatcacagaaggtatcattttcttgataagatctttcttttcattaagaacaatttccctaacatgtgctcaggctgccatgtatggctgttcagactatatatggcacaattcaggaagaacaattaacagagaatacatgtaaagggtaagtcctgcacctgtaaaaaaggggtgggtctgctatggagataccaaagaaatatagtatatttccctccctgccttcaaggactttatatttaagttgaattgtcatggggtgttggggatgggatgtatataatacacagcctatgtacaaagcattagggtaggtactggcactgtctgggttgctttcccagatggacatggaattaggatttaaagtatgtatgaccaataaatatgtaggaaaaattaatttcatacagagaaaacaataagaataaaaccatcaagatagactaaaaaactgttatatgccttatataatttaaatatttcatataaaaagtcctgtgttgaaaaaagaaaatattccaactgtctcaagaattggttattcccacattcagatatttaaggtaaagaagaaatctaacgcacaatttatatccctatttttgtgtaaccaaggctcaagcatggctgggacacttacttcttcttagtcggtttctgatttattttttatccctaacattgtggaagaaacttccctttcacgttaacatttcttcaaaggagtttaggcacaaatgttttttctgtaacacaggcagaggcgataatatataatatagagtatctaatatatgtaggtactctatttcctgaatgaatagatggatggatggatagatagatcattgaattccttcatgtgacttccttcattatattaagaagtaagaaaaatataatgaatatattatagggcaacctctagcagtgttggaaaaagtgctaattgttagaaaaccccatagattgaaaaacaagtatacagaatttcttgaaaatgatagaattaattccattgagaatcacttagtagctcttatttgccacttattggtaaatattgtgcgatcgcgttataattttcaatgttgcagcagtcatcactgaaacactgaatggccctaattatacagggagaaataagacatgatgcattaatatattagtgaggaacagtaaaaattcttaatggttttgagatagagccttgaatgttgatatatatatccctggttacctctgccatcctctggttctggtccacagctctgtgattctctgatatggtggatccctcattccaggaaggctgttaagatcctgcctcatccaatcacaccactgtgcattcttgatctcatccttgtcatctaggtcttttggtttgcggcttcatggtaaatcaaaaggaaagtaactttagacaaatccaagttattatttctagcagtctttgaacctggataagcctgtgaagttggactagctcaaaaatttctccacatgtatgccatttgctcctcagaacaagtcaggcatgtgtagttagactcattgggtagctcaatagattgacaccgagttgttactgacttgcccaaggttacacagctaataagcaggagagccacatccaggattcagggcttctgccacataaattgatgttctctcaatgactccaggctgcctttcaaaaactggagaatatgattatttcaaatcatctaatgggtaaaataaatattaccacttaaaattgatcactaagctgctgttaatcaatggtccctatttttaacgagtctatactgctcaatgttgtgagttaggaaaaaaattgttattttagaaaaacaaaatatatacttgaactttctcaggtgttccagttttttaaagtttgaaacagaatcatatcttgccatttcatctcaactcttcatcagatgaacagatatctaagattaaacacttctaaagcatattctgtgattcttcagaaagtaaacctagagttttgtgcttaggaaatgatacttgtatcatttattctttaaaattgagatatttctccactgccattagagcacttatttgtattgtgaaagaaattccctttctacttcaaagatacctagtaccttattttaaaactaaaatgctagtttactgatactgtcacttagcttacttccttagaatactaaaattcaggttggtcatttgggactagttgtattagctcatttctcttatgaacaatcaggagccactttaaatcttattactccttaccataaatctttttttttgagtctactttttattatcaccaaacacaagcagtgttagataatatctgtgataaaagtcatcttgtgcaaaaaattatgctctaagttctgaaaaattgatacagttactgttgagttgtaataaaatagggaggtgtcttagcagtttctaaatgtcttctttaataaggaattgtattctctgcggaaagtaacagaaagtaatttggagaacactcaggtatgcgggttgattctcccaacacatgtatccagaactatgtttcattttgggagtgaatttgtaatgaactggaagcattgattctgactgtgggtgtagtttatgtccataaatcttttaactcactaggacccaatgtgagttctgagatctacattagcttagtatttatgaactgtttagggaaagtccttgtcttgcatcctgagtgtctgtgaatgtcatccaatttagaaggcacacctaaaaccaagaaacaatcaaatgactgatttttttcctccactcactgtgactaagagggagtgtttcatcctcacaataagaggaaatctcatttctttggaaaagattttcagtgttatctctactccgttgcttaaggagaaattacaatggcaacttttgttttaaaaatcaggatgatttaatgttatgaagaattgtcccccccccctttttttttagatgtttgagtcaatgttaagggcagatttactttaaatagcaacgtgaccagcaaagcttgaaaagttctcagcaatgtgtccatagagtgtttataaaggctgttttcagtttcaccttcctgctccactgcagagtgacaatttgtgactaattgctttcactatctaaatgtactgacatggctttcctttttttttaaactcaaagaagtttgattacttttatctttctcaagactcaaaaagaagtatgttcaaatgttggatgcgtaacaagtaggaattgttcttgctgaattaatagattaaagaatctatgacatcataagcaatttcccaattgggtgagttttatgccaaagtgataacacataacaattttttatagtaatatgattttttttcaaaatgaatcagaccaacatcaattattgacatatttataaataaacaaaaatagttttgcctgattcgaccatggtgaaatttgtcaaatagaataaactctacctattgttataagtagggttatatttgtggtgaggaatttaaaacagaaagagagaaaaaaatatgtagccaagtaaagataaagtgaactccaggaaaagtaacataatgaaaaaagtaattcaacattgtaaattattaatagtgacagcttattatgtatccctgtagaaaaatacatggggaacacaggaaaatccactggttagttagattaaaaataacatggcaaaacaccatctctacaaaaaataccaaaactagccaggcatggtggtgcacacctgtagtctcagctactggggaggacgagcaattgcttgagcctgggagatggagattgcaatgagctgagatcgcgccactgcactctagcctgggtgacagagtaaaactttgtctcaaaacaaacaaagaaacaaagaaacaaaaagcacaaaacaaaaaccaaccagaccacttgtgtgtgttatgtgaattatgtgactgaaattttcactttgaacaagttgtgctaatatggtgaaaacacagactacctcttgtgcttacacttgattaaaaaagaaaatgagcacagaaatatttgtgtattatattctatttccctctcctcctttacatcttttttctttgtttttttgtttgcttatttcatgagtattaccaaaaaaagaggaaaagttaggtgtgccttagaaccattgaagaaagaagagaggagaaccagaaagcagaacataatccttaaggaggatttcctaaattaccaaattgtcctacaaatttgttaaatcaagtttagcctaaagctgcctccttacgtgtttaagttcgacctaaagtttattctgtacatggtgaactataacaagtggagatgtaacccactgtagcctacacctgtgccagtcactgagttttggccaatcaaatgtagccaacccttagaaacacgttcaaataaggcaaatgctgagctgtaaccaatccagctgtttctgtacctcattttccttttgctgtccataaatcttcttccaccatgtcgctgcactggagtctctctgaatctgctgtgattctgggggctgacccatctacaaatagttcattgctcaattagacgcctttaaatttaattcagctgaagtttttcttttatcaaaactctttgctctatctttattgttttacaacttccataaggaaaagaaaagaggggaaaaatggaggcctgtctggtgtttccttttgcaaagagagttaggaatgctgcccacaggaataaggtgataggtttagtgcctcgtggaattttgtttttgctcaactataaagccggctgaaaacaatatatctttctatattattagtaaatgctcagaagttcacttgatttttatttactaggcagttacttatgtaaacatgttacaaaaagtagcacagttttaatagggagtccaggaatgagaaaaatctgagttctaagccctgttctcccactgggtatctgctagagattgagacccttgtacatcgttggtgagaatttaaaaatgtaacttgaatatcttttgtttgccaaccaggactcactaaaggcaatgctacattgcaactaatataaatatagctaatggaaagtaaaattattcaaatactatgagcacttttaaattttaaaagaagatgtatttgccacacattttttgctcctacaagcagtatcagaaaattgtatccagtttatctgaatcctagtaacactgaaatctaaaaacttttaagcctaaagataaaccttgttcaagaaaactgatgccattaataattttaatttatttttaattttagttgctttattgaagtataattgaaatacacagaactagacatatttagtgcatacatctaatgagtttgaacatgtgccaaactcatgatgccatcaccaccgttgaggcaatacacatatcactacaaagagaataatatacctaggaagacaacttacaagggatgtgaaggaccttttcaaagagaactacaaacaactgctcaaggaaataagagaggacacaaaaaaatgggaaaacactcacgctcatggataggaagaatcaatattgtgaaaatggccatactgcccaaagtaatttatagattcaatgctctccccaccaagctaccattgactttcttcacagaattagaaaaagactactttaaatttcatatggaaccaaaaaagagcccatatagccaagataatcctaagcaaaaagaacaaagctggaggcgttacgctacctaacttcaaactatactagaaggctacagtaaccaaaacagcatggtactagtatcaaaacagatatatagaccaatggaacagaagagaggcctcagaaataatgccacacatctacaaccatctgatctttgacaaacctgacaaaaacaagccatgaggaaaggatctatttaatacatgatgttgggaaaactggctagccatatgcagaaagcggaaactggaccccttccttaccccttacacaaacattaactcaagatggattaaagacttaaacgttagacctaaaaccataaaaaccctagaagaaaacctaggcattaccattcaggacataggcatgggcaaggacttcatgtctaaaacaccaaaagcaatggcaacaaaagccaaaattgacaaatgggatctaattaaactaaagagcttctgcacagcaaaagaaactatcattagagtgaacaggcaacctacagaatgggagaaaatttttgcaatctactcatctgacaaagggctaatatccagaatctacaaggaactgaaacaaatttacaagaaaaaaacaaacaaccccatcaaaaagtgggcaaaggatatgaacagacacttctcaaaagaagacatttatgcagccaacaaacatgaaaaaacggtcatcatcactggtcattagagaaatgcaaatcaaaaccacaatgagataccatttcactccagttagaagggcaatcattaaaaagacaagaaacaacagatgctggagaggatgtggagaaataggaatacttttgtgctgctggtaggagtataaattaatttaaccattgtggaagacagtgtggtgattcctcaaggatctagaagcagaaataccatttgacccagcaatctaatttctgggtatatacccaaaggattagaaatcattctactgtaaagacatatatgcacacatacgtttattgcagcactgttcacaatagcaaagacttggaaccaacccaaatgcacatcaatgacagactggataaagaaaatgtggcacatatataccatggaatactatgtagccttgaaaaaggatgagtttatttcctttgcagggacatggataaaactggaaaccaccattctcagcaaactaacataagaacagaaaaccaaacactgcatgttgtcactcataagtgagagttgaacaatgagaacacatggacacagagaggtgaacatcacacaccagggcctgtaaggggatcggggctaggggagggatagcattaggagaaatacttaatgtagatgataggttgatgggtgcagcaaaccaccatggcatgtgtatacctatgcctgcacattctgcacatgtttcccagaacttaaagtataataataaaaaaaaatgtaatagagaagaaaaataaataaaaatctaaaaaaaaaaaaagaatatgggatcacagatcgcaatgaaatgaatgggatgaaattctctctgtcatagcacttgaggacgaatccaccagtggattccatccaaaaggctctgaaacaacaagggacttagtgcaggctgtggtccttggctccttggatagtaggcattcaatgaccaagccactttcatttttgatgttatgcaattagatattaaaatgaaaaagaagttatcttttgaaaacactacttttaacagcatgtggcataccatttgctatcttaattccataatttcaaattgtagttttcaattagggtctgccaatcatttccagcctccttttgggatttcaaggagcttatgttctaacgtggtattttgtgtggatagcagaataaactaagtgtggatgggttggtccagttgttaaggacatgggtgctaatgagacccagggggtgggtttggcctctgcctgcaagcggaacagtagatggtacttttgttccatggccacaggctacaggcacaactaaatggttatctcccagatgcttttacccacaaagggatgaggtgagaaggtgtagattaatcatgaaaccccttcatcgctcctgggaaagcagaaatcctagtatggatcaagacatgcatatgagcaacaatgaattttaaattccaaaactgagggtactgtaagttcactgtattgaaagttgctgatggagtccagagtctgttagaacataaaaagcatgtggtttgtattttagagacataagacagtgcatttagtctgcatatctgaacactttttccttagagattttccctgttaaatgggacatttgacatggtagaacagcatgtgcaggcaaagcacattcagaacttcattgttttgaattggctataacaaagcacaaagttctttctaggcactccagcatagctctttccaagtctgggctccaaaagggatagattaaacaggaagggtaccatgtaatgctaattcagtcttatctaattcagttcagtaaaaatctcagtatttttggtgttcaatataccaggtagacattgtggaaaacggaaaggcaagtaagacatcactcatgacttccagaggtttatattattgtaagggaggtggacatggatgaattaaaggtcctagaaagcagactctgagaacaatggaaatacaggtacaagggcaatgagggctcaggagagaccacatgatcgattccaactggggaaaccacagagagcatcctggaaaagttacaaaactttaaagaatgagtggacttaagtatgctcagttactctgtttaatctatgtattatttatttattcttccattgatttattgaacaaatactttgggattcctactatgtaacagttatgttggtaggagctacacaagtggatcatggaatctggagttgaagacagacattattcaaatgatcacatgacttactatgagctgatctgtgttctgaggaaaaataattgactatgtaaaatataacagaggaaagaggcttagaccagggtttggggaatgcctgacatgaaacttgacctgagatatgaaaaataaatagatgtcaattggtgataaacggggttgggcccacagttccggtaagaggaagggcatgagtatcattgacttcatgatgcaagctggtgagaatgatcattttatcagagactgtttgctgtgcagagagagagactgcacgtgttaaaagcacattttctggagccagattgcctggattccaatcccagctccaccactcaccagctgtgtaaccttgggcacttcgcttctcatttctaggcttcattccctcactgtaaatggggtaagtgtaagacttatctcagagagttacagtgtagatagtatacattcataatgataaaataatatattactgattaactagattaatatacaatgttaatataataatatttaggattaaatgtattaattcattattcattaaaattatttcctgacataaatcttataaattgtatattatagaaaaaatagtaaatatgtaatagaatattagaatcatatatatgagaataataatagacattattattattatacccatgagtctaagttgaaaactctgaattttctgatttaataagtctgtatttggccatatatttctttcccttctataacatcttttcaattctccaaacaactaggatctctgggtgttcttttgcctctttttctaaaaacaatcatttataggacatctcattctgactcatcaaataaagtcactgaaatatgacattcttacttagtgggtggaaacaaagggatttttaagagaagcaacattttttcagcatgttttatgagtgcaaatcatagcatagtaaaatgatgcaatcctccgtgttttgttttccacaataaactttctttctcctaatagttaagatcgtatatatttttcagatttacccatctcaagatcagtaatgcatgattttattacacccataattttaccctcatgtgctgacatatacaaatttattttggtggcatgttcttaatttctggagctgccatgccattttcttgactagttttattttggttttgactaatctcttataattttgaaaaatagagcactttattttatggtttatatttttaataatcataactctcttttcttcggttaacaattcccccaggtttaaattaattcctgtccatttaccctccattgaagcatagcattacatgaatttatgttacagcagcatacgtggtgccgaatacataaaacatataaaatataatcacacacacacacacacacacacacacacacatatatatatgtatacatatacatatattttttaatttatttcatttttgcctaggctggactgcactggggctatcgtggctcactgcaacctctgctgtccgggttcaagcgattctcctgcctcagccactcgagtagctgggattacagacacccaccaccacacccagctaatttttgtatttttagtagagacggggttccaccaggttggccaggctggtcttgaactcctgatctcgggtgatccgcccacctcggcctcccaaagtgctgagattataggtgtgagccaccatgcccagctacatatatatgtttttgcctttccaattagataacaaatctttgagggtgggagccaggcttgtgatttttctagtattgttccagagtatcctgcgctgggctcagcacaaaacagttgctccataaagtctagttggatttaattgaagtacttctgtagcaaaactttgcagcacttactttggggcagctttctcagctggtaagtatcaatgaaaacttaaatgactgtgaaataaattatcttaaatgtaaaagtcaaaaataaaaatcaattacttttctattttgttcaatggtttttatggaaaatataggcttgcctatcctcacctactaagttgtcatacaacaatatatctgaataaataagattttctggtaacacattgtatattttgaatgaaattcagttacttgagttttgaaaatggcttaaatgggctagaaagacataaaacggtgagctgcctcacttttatagcagctgtgtgagactatgattataaaaacatgccatgtaaaggtatcaatctgctacaaattttcctgacagaatttgtggaatattcttcatttccaagaccattaccagaaaataaaagcctgagattcaacactgtcaatccaatcatctggttagacttataccttggtctaacagtttactgaaaattaccaccaggaaaacccaatcatctccaaataagtgacattattttacactaaatttagcaaactaatctaactatacatggggtgaacacttaattgtctacctacatttgcaatacataaaaaggcaacagttttctatatatgtgaaaaatagtcgctctgagttcaccaagccttaggttatgctacataatttgatttttataacactatatatccaggtatcaaatttttctgattaagaaaatgacataaaataaaatttgctaaaatcaaattaaacgcctttgagttttgccatttagtttccaactaaagcgtatgcgaattatttctccacatgtacttctatttcttaattacttctgcttccactcatatgcttttcttccttaggaaaggcagtttcttcttaaaaactgacttagattctgagtggggggcagtagaagccagtcctgtcgtagaagatgcctgacacgggatggagggtttggagtgctttgcatgcccagaggggcaaaaatattgagaagggttgttgaaaagaaacacaagcaccgatgtcataggaaggaggtctgactttatcttgcaggtgatgggaagccggagatatagaaataactttgctttaactttaaaattatttgctaaagtatccattatttaaatacaggcatcatgattgttcgtgtgctatattagtttgagtcttgtaaaagacaaaaaaactgtaatattttaatttatttcagtgtatttccatctttattttttgaaaaaaaaaaagagtaaatcttactcctgcaacttttcagtgtatatctgtctttatttttgaaaaaaaaaaaaaagagtaaattttactcctgcaacttataggtaagcattttccaaagcgtcatggttttctagggtgtgccataatgtaaaggaaatcaccttgtatctaagtaacattctcagacaaagtctgcacttcctaaaacctggatgcacagacacttagtatagaatgaagcttaatgagtaaaaacaatagtacaatctatcttgcttcagtattttgttttgccaggtgatgtggtaggtaaatgaacatatctttctttgattgtgcctgcataacacatgatacaatgactatttgttaccagacttatttcatttcaaaatgagataatagattattgaatcaaagccagaaagtcaatcaggctaatctcagtaccagacctgaaacaattatgtgtctctattgtatagaagcttgtatttggctgatgaatctattttaatctttttaatactttatttgtattatactcttgattatggctatcttgacagtaataaatgacttcattaaacaagtagctaattaaataagtacctagataccaataaacagctgaacatagaaaccaaagttgtttagcagaacttaactaaagctacaattgagcgtcattgtttccagctacttgtcaagcattaatgactttttttatataaacaactgaggtgataatacagccattttaagattgaggaaaaaattaacagaagtgttaaatcatccagttgttggcacagctatcagagatgactggcgtttgtacagaatctccatcctgaaaccatcttctagctcttctttaacttgaagtgtaaaatttttttgaaattaacccataaattttcaattatattcactggtcttgggttactaacatgttatttactacgttcttaagaaaaaggattcactgataagttattttcttcctacaactgtgattatttttctttcatagacacctcctcaccatataatctatgtctctaactggagcctcaagactaagttgttagcttggtttctgcctcaggtacaaggcacatttattaattcatttatgtaatcattcatgtaataattcaattacatatatacaaaagcgatagtggagtctgtatttctcattttctccatttttcttgaagaaacaaagaaatagtaaatcttttttttttttttgcaaagagatctggggttacagattaataattacacatcttcaaagagtttccacattgtgggaagccactaaataatgaaattgcaacataagtgcaatggtagatataaatattcaaactcagatcttctttctaaccccaatttaacggggtatggttgtcaggtttttgttttagtgaaagcagcttctgagatacactttgctaagagttaatactcaaagggtatgggggtgattaagttatttctgatgctggagaaagaataacaaagcagataataaaaggatgttcatgctgttttcttgtggttgaattttatgttgaacattagtgcagggattgggagaagtagagtttaaaggattttcaataatggcatgatcaggtttgaattttacaatgatttgaaacctgttaaatgaatatgagttgattaattctgcgagtgattgattgattgatttgccacctactgattcccatactacacctctagcgttaggattagctacattcttgctatagtttcctattaagggtcctactatccctgcatcacttcatatgtttctgggtaattactttaagtacctgcaccccagtgatctttgatgtcatcagtatcaataatctattgattctaccagcttttcatcatccatcaccactctgatattctcacttctcttcttgcctaccttatattatataatatagccattccatcctttcccttctgtgagaaataattccaaacctgcttaatgccacctctctgctacacctgcattcaggctgttgaaaaacatgcgatattgttggcttgccttactctatattgatgaacctttagtgctagctaacaattctgcttgtttcctttctatttgaccacaaaaataaaaacaggcagaaaagaacatccatggtaccaccgacttctgctaacttgcttgtctcttcagccatctgtcttcactccagttttgatggatgagttgtctcttcctatccaaggctgagccttttccttgtgaactccattacatcactgctcataatcaaagtcattgctcagaaattccccctcccaccctctccatctaattaagttttctctctgtagaagcattttcgtcaatacaaaaacatactgcagtgtcctccacagcaaaaataaagaaataatttcattgatctggcattcaactctagctatattttcatgttgttccccttttctgagaaatttcccctcaaaagttgtctgcatctgtggcatcctttgtctttccttccattctctcttgaatacactccgattaaaattttagcacccactatgccattaaaacagcttctgtcagtgacttctaaattatcagatccaatggtcatttattgatctttatctactcacacagttgcctaatctgaaacagttgatcacaactttcttttggaaacacttttattagtggaaatgttgagtgagaattggctaggaaatggaagattggggaagtgggggaatagttttgttttaaaatttttcattaggtaaaaatctcagttatataatatttaattatttctcagggccacctagagactacaagatacattcctgactaatcaaagtgaaattccacttgtatttttaccccttttgtgcacaaggtaggacttttcgtgtctttgatttcatttactgcttccaaattgtacacatttaaaagagtattttaataatacacgtataaaactctacaacatattacaattagtgttttatacaattaatattgtcatttacaacataattattctttgacttgttctgtattctttcttatattttctttttctcttgattaattcattttagtattactttagtgtacttccttctctggtgataaattctctgtatttacttatccttattcttgaaggatttcttcactgaaaagttatgggttgtcagtcatttaatttcagcattgcttctttctctggcttttattttgtctcttgagaagtcagctcttggtttaacttttgctcgtttgaaggtaaattgcctttttttctcatgctgccttgaatattttatcctttttcaaaaggataaaataaaaaagacaacttttttctcatgctgcttttaatattttaataaatacaataaaaataggataatttgtatcctattttaaaattgtgtaatattcctatacatacataaaaaaacttgtatatgtgtttcctgcttgaatctcttttatgtgtttcatcagttttgaaatttttagacattttattttcaaaatttcttctgctttattctctccttccccactggaattaccatatctattcattagacctattcactgtattctctatgtctgctaccttctcttccatactttcaatcttttgtgtctttgtgtttcctcctggatagtttcttctaaactatcctttgattcactaattctaactcttactaatctgctattaactcatctattagtttcttagtattgctattatggtttctttttcattctgccttcccttctttatatgtttccattatctgtctattctctcatttctatcttttgtttactggaacataagaagcataattactttaaattcggtaccacaaccaccatgggtctgtttctactgtcatttaattctgctctttataaaatgttatactttcaggaactaggttattttttattgtgtgccaaatatggtattttttaaatataacaataaattgagagttgtcttagaaattgagaaaattcctggtgggggttcatactaacttttagaatgtggctcattggatgccagtctaaacacggagactctctctgcagcctgattcccatatgtatagctctgaactcctgcttgtatcttactaggcatgtaaatttccaataattctattctattcagctttttaacttctcagccaccttctccagaatctgcacatattcccaggataaaagaagtctcagcttctgggctcattatttagggttcttgtctcttcccagactatggttcagtaattaaaaaaaaagattccaacattcagaatgaaaaagaagaatacaatgagattccaagtatctattcagattaaacaattatccttttcattttagctttttgatgcccaagaagacagttttgtttgtttgtttgtttgttttgttttgttttatcttttgtggagctttgagtttttctcagaggtaaggttgttctcatttacacatgtagtctaccattagaatttgaagtccttgcaggccttgggactctttcttctgttgagctctagagaagcacttcactttttctttcttttttttttttttttttttaactttaagttctagggtacttgtgcacaacacgcaggtttgttacacatgtatacatgtgccatgttggtgtgctgcacccattaactcatcatttacattagatacatctcctaatgctatccctccccgctcccccaactccacgacaggccctggtgtgtgatgttccccttcctgtgtccaagtgttctcactgttcaattcccacctatgagtgagaacatgcggtccactttttcaaagctcttaccttaccccttcctctctctctctcctttgcagcttctccttatcttgctaacttataaatgctgatttattaggctcattccccaccctcctcttctatccacactcattacaccttgtttcatggtttaaaagaatttttgtgtgctgataacttccaaatttttatgtccagctcagttttctcttctgacctccaacctctggtttacaaaccaaaatggttattcaacatctttatctggatttcaaacattcatccttaataccccaaactagttactttcctagtctttccgaacttagttattggtgattctgttcttctagtatttaggttaaagaacttgttgtcatccttgtcttttcatttttctcttaaaccccacatccaagcaatctgtaattgtattgatgttgtctttaaactatatccagaatactcaggccccttctccaaacctcttttttaacgtcgtggcccaagattccgcattattgtaacagattcctatcttttctgtttctatcattgcatcccctctgccaatctattccatactcagcagtaagaatgatcattttaagccaataacctaactgataacctcttgtagtgattgtaggaactattcttagtgctttaaatatgttaacattttgttttgttttgttttgtttttgatacggggtttcactcttgttgcccaagctggagtgcaatggcgccatctcggctcactgcaacctccacctcccgggttcaagcaattctcctgcctcagcctccctcctgattagctgggattacaggcatgaaccaccaccacaacgaaaaattgtctggctcaaatgtcagaaatgctgaggttgagctctaacacatagagctgcacaggtgttaggatgagggcaagagtgaagcacagctcaaacagagagaacttgaagacatgggctacccatatgaaagagaaaaaagtcctattcacatcctggaacaaagattgctatcttcggaacacggataacaggaatatcaacacagtggtgggtggcatcgtgcgtgaacttggaagacaatgaccacagatgatcaggagcttatctcagcttgcctcaaactaccttccccagggcatttggtgattacgcacatcccagcccatctgttgctaattgcaataaagaccaggatctgttatatcactgaggtgaaacctcatcaagttttagaggaaataaatctacgagatgctccataaaagtaatctctactttttggcatccaaatctgtcaagcattgatgaggcaagcaggaaacctaatgaaaataatacaaggaaatcttctcatcaacacccatccctaatgtctcagctgtcaggtcattgttttggcttcttggggtggaatctgcatcgacagccagtatcagaagcgctgactttaaacaaggcaagcagtcatttttaccatgtggtccaaatcagttaaagggtgccagccctgcctcaatttaaatgggttggtttttaagtgtgtttatattctagcttctctcactctcatgcgcaagcaaacacacacacttctagacactgggcctttagtgtttgtgatgtaggcatctatattttttcccctaaggaacatgcacagaaaaatttctgtgggttaaaaggcctttgctttattggcaaggatagcaatggaactaatttggtgttttgcgttgacgccttctttctcctgacttgtgtaataagatcgttatataagatgataattaccttacttgatctgtaaggagaattaaatatgaggataactttctactatgccctctaaaacgtcctggtgaagaacttaatagaagcctatgataaaggttgaaccctgggaacataaattctgttggggtgtatgcattgaggtaagcagagttgcgtgctgggtttgtgaaggcagagaaggggacagggcagggcaggatatcctcttcattagcattatacattgcttttctcatcattatcgtggcagagtcacacaaattatcctggtccaaacacttagagggccataaactgaacccacccttccattaggttcaaaggaaaatgattacacaaggaaacttgtcatgtcctgtctagatagataatgtagccggataatgaagattaaaaaatggcctggtggcactgtgaagaggttaaagtactactgcaaggtgcaaaggaaacatgaatgatccaaatcctagaagaaaacacagcttagcagcagaaggtttgtttatattataataacaggctcattcttttctaactcataggtagcatttccttttgactctttgagcagaaaagcaagagtgggcagaaatgacctcagtagataagcaaggcattatactggtgctttggtgcttgataggagttcaatacataattttattcttaaaaaaatcacttagtaaggacctaatatgtgctaagcactggttaggagatacaaaatacaagaaaaataaggacatggtttctgaactccaggaatgtaaaatggaattggaggtgatagatacactaattattgttaagaatgggttgtcaaattatggcccatgagccaaatctagcccactgcctgtttttgtgaataaagtttgattggagcacagccctgcccattcatttatatgttgtctgtgcctgcttttacacttcaacagcagtgttaaatagttacaacagagaccgagaccctatggcttccaaagtgtgaaatatttaatatctggtactttacataaatgtccctgtagctaggacagtaggtatgtagcctacattaatgtcgcatacatggaagtaaacactttttgaacactactgtagttagtgtaccaacgtccattgtggtaactaccatattacccacattttggagattaaaaaatgtagcttaaacattaaatactttaagttctcaatgtcacatgagcaatatggatttgaaaccatacattccgatttttacagcccatgctcttaactgataccctctgtagacaagagctgtacatattcaataggaacagatatgtctttgtcaattttcatatcaaggtgttcaagaattaattttcttttctttctataaccgaattaaattctcccttgtattttctttttcctgtttgcagaatcctgtttagttttagaaaaagagccaattcaaagtttgtcctcttctttatttgatagtttaatcattgttctcaaggctgtgctagattgataaccatggttctaaccttcaccctttctgtatcctggccctctaccatataactttacagtgtatttctgactgtgatggggtgtatttctcctccggacacagctctgtgactttttttgatcagtgggatattagcagacatgatagaaagaaacggacagtcctcaagtgactaggcttatcctctcttcttcctctgctactcagccgtattctcatggcagtagaaacagcagaaaataagaaacatgtgaaacagagccaagtcacctccagtgcttcaactcacagccggctgatttcaagacaagtaaaaaaaagtccagaaaaaaaataaacaatagatgtttatcattgtatccactgagagcttatggttatttgctatgcaatgtaattttggtaataggcaacgggtacaggggaatatataacatagagacagtgggcagagagtaggagagtatgtcggtctggttctttgttattattgcttcctaatgccatcttctgagaagcagatcatccaatctgaaccctgagcatcatgacccctccaaattggagcttagaaatatgtaagtggggagttaaagaatacaaaagcaccaaagagctggaaaagcaggatggataccactgaagagtaagttagtgacctagaagactaagcataagtttttagaaaacaaattacggaaaaaatttaaaaagaagacagtaggataaaggttaatgagatgtaaaaatagatcccaaagttatactatcagaaataccagaagagagaaaaattcatctcagaatcgaataaataaattctcaaattggaaaagactcacaaagttccaagaaatatgaatgcttttaataagtaaaatttaaccctcaacatacccctatgatataggtaatatgatatcacaatttcacagatgggtaactaagatatgaagattttaatcttcctagccactttatatgttgacactcatccccatgacattgttaattctcaaaaccattctttgaaatatgcgctataattattccaggctaacagatggaaaactagagcatagagaaattaagtaatttatgcaaggtcatgcaggtaataagtgccagaaatgggtctctaaccaagatgtcctggctcaaaagttatatgcttaaccattatgccattgttgccatatagctgactgaatggaaagttacaagtaaacacaaatggaacttttaattctcattgcatacagattttaaaaaatcatgaagcagtatcttcaaacttcagagtgtgcgtatatatatatgtaaatatatatataaatattaagccagacttctagattggttttattttctcatattgtaattcagtcgtggatttaggacttttgctttggactatagtaaagtgactggtataggacttgacctcccaccacaagcaactagaaaactggaaaaaatatagaaaaaagagctgttttttagatattcgacaatggatagtatctgtgatctgagaaaaggacaaatgaggtatgctcaacaattcctcctgctttctgctcaaaagcactcattggcctgcaatatgaaattcatcacactttaaaaaagactaaaaaaattagattcccactattattttaccaataatacatataattcaatcaaaattgtctagacatgtacagaagaaggaaaatatgaaccataatcaggagaaaaattctgcagaaacaggtcccgagataacagagatacaggaagtggcagacagggactttacaagagctattgtgcacaaataaaagaagaaaaacaaatgtcctgcaccactcaatacaatacttcccctctggtcatcaaaatacgtgttgggagttctccctacacaccaagcaattctccagcggacactaaccggatgtcctataatttaattcaattctgatactacctacctggagactgtgtcagattccacaggtgaaggttttggttccacaaaactgtccctacttcagatgccaatcacaagccatccataacctttgcgttcccagaaaccacttcttgggttcaattactttgctagagtgcctcacaaaatttagggaaagacttcacttatgtttactgatgtattacaagggatgttacaaaggatacgtagagggaaaagatccataggacaagacatgtgggaagggacccagaacttacaagccctctctaggtgcgccaccctccagacacctccaagtgttcagctgtccagaggctccccaaaccccactctttttttttttttttgagaccaagtctcgctctgtctcccaggctaaagtgcagtggcgcgatctcggctcactgcaagctccgcctcccgggttcacgccattctcctggctcagcctcccgagtagctgggactacaggcgcccgctaccacgcccggctaatttttttgtatttttagtagagacggggtttcaccgtgttagccaggatggtctcctgaccttgtgatcctcccgcctcggcctcccaaagtgctgggattacaggcgtgagccagcgcacccggccccttttgggtttttatggaggtttaattgcatggatgtaattggttacatcactaacgtgagttatcaacctaaccttcagccacgctctcttccccggaggtcgggccctattctgagctatgctggagcctgccaaaagtcacctcattagaacaaaagatgcttctatcacccagcaaatttcaagggatttaggagctcagcaccaggaactggaatcaaagaccaaataggaaaacagaagagtgtcctagcgcccctatcgacaggggtttttgaagctctgtgtcaggaactgggggcagaaaccaaatatatatgtgtgtgtgtgtgtatatatataatatcacaatattacaatatggttaaggatttccagaaaaaaaatacggataagaagagaaatgaaagacatcgttttaaatcagtggaatttctagaaaagaaaaacacaatgtttgaaatgaaaaattaattgtatcggcttcatagaagattagacattggaaaagtaaaaaacagtaaaactgaagatatgacaagagaataattctgaaatgaaaacagagagaaacaggtttaaaaaaaagtgactaagtctcgatgacttgtgacatcaagtggtagaacatggagatccataggccaggcgcagtggctcgcgcctgtaatcccagcactttgggaggccaaggcaggtggatcacttgcagtctggagtttgataccagcctggccaacacggggaaacactatctctactgaaaatacaaaaaattagccaggtgtggtggcatgcacctgtagtcccagctactccagaggctgaggcaggagaatcgcttaaacccagaaggtggaggttgaagtaagctgaggttgcaccactgcattccagcttgggcaacagagtgagactctgtctcaaaaaaccaaaacaaaaacaaaaaaacaaacaaacaaaaaaaagagatccagaagtaaagtggaattgaaaaagaattgaagaaataataactgcaagtttatagtcccatgaagctaaataatctcaaatataataaagaaataaaataacactgagtcacatcacaatcaaaaggctaaaaactagagataagagacaatcttaaagaggcagagtaaaaaagatggacatattacctacaggcaagtaaagttaaaattaaccacatgcttttaagaaaacaatggaagccagagtttagtgaagtaataattttaaagttctgaaataaaaaaattcaatgtgaaattctacatctaataaaaatattttttagaaataagggagaaataaatatttttagacaaagaaacctgagagatttactgtcagtaatgtgtactgtaagaaatattaaagttttcctcaggtagaagaaaaataagaacaaatagaaacttggaaggccaccacaagtagtaaatatgtgggtaaatactgacatttaaaaatatataattaaatgtctaaattttaaaaagtatgttgaaatttataacacatgtagaagtaaaagtatgtactagaagcactaacacaaggatagaagatgaaaaatgaaagtattttgttgtaaagcttttttattacacataatgtggtatgatattatttgaatgcaggcagttataagttaaagatacttattgtaaactctaaagcaatcactacaaaaattagaaatagaacagctaataattcaatgatggagaaaaagtataatataatatgcaaatatgctgaacgcaaaaaaggcagaagcacaagaaacaaataaaaagcgtgacaaatagaaaataaatagcaagataatagattgaagtccaaccatactgataatcaattaaatataaatggcctaaatactatagttaaaaggcagataggtaactgccatagactgtattatctcccagagctccaggagtcatattaactttgttttccccacttttccctcatatcactgatatgctgtggtttaatctgaatcaaatttaagtgcatgagacagagctacagtaggagaaatagcagccaccaagctggctttagagatttgtagaaatagtaatgtcatgtctattaaaaagcccattgtgaagggagatctgcaggatttacaagttctctaccgtgtcacaagcaccactagaactaccagtaccaccagtaagtattacagtgatagggaggaaatagatggtgaaggttataaggtttgcaaggaggagaggaggatttgcaatatgcaagatatgcataagatgaacaattataatgaatctcttgatgagggagaagataatacagtagacagggaaggccaataactgggccaggaccagggaataatctaggacaggtatcagtaactaggttccatgggtccaatccagcccataaaatctaagatgtttactctctggccctttacagaaaaatttgcagcttcctggtatagagggaaggaaaaaaagttgcctcaaggaaaccctggggcatctccacacttgctgcaccctttgccaagctgctggtggctcagggcctgaaatctcacattaaacccttttgagatgttgcaaggtcctgacctccttgacttctcttggaccatcagcccgctcctaaatctcttgaggcagaacccccatgtgggcagcattttgcttcttgtttgccaagtttgcaattttagctcctctctctctctctctctctctctctctctctctttctgagaaagagtcttgctctgtcacccaggctggagtgtagtggtatgatctcggctcactgcactgcagcttccacctcctgggtgcaagtgatcctcctgcctcagcatcctgagtagctgaaattacagtgtgatctcggctcactgcaacctccacctcctgggtgcaagtgatcctcctgcctcagcctcccgagtagctggaattacaggtcgcaccaccacacccggctaatttttgtgttttcagtagaggtggggttttgccatgttgcctatactgacctcgaactcttggcctcaagtgatccacccaccttagcctcccaaagtgccgagattacaggtgtgagccactgcacctggcctctatctttctttaataaagacatggcactaattgaataaaatccagaggttgtcagactggaaaaaaagaactcactatttctgtccataagaaacctacttaaatataaagacatatttaaaagacagaaaaagatgtagcaggcaaggactattcatgaagaaataggagtggctatattagtatccagaaaatgtaggcccaggacaagcattattgccagacataaagtgggacattttgagtcaattcattaagaagcagtaacactcctaaataagtatgtgctaaataacagagcttcaaaatacatcaactgaaaatatagaaaatcaacaattataactggagatttcaacaatcctctttcagtaaatgatacaagtggccaaaaataccaggaagaatgtaaaagacctaaacaatactatcaaacaacttgacatgtgatatttatagaacaagttactcaacaacagtagaatatgtattcttttcaggtgtacataataaattcaccaagtctctagaaagctgatgacttaagtattacagactgttttctgactacaatgaaattaaattggaaataaataataaaaagatatctgtaaaaatccccaaatatttggacattgagtaatacatttttaaataaccaataaatcagttaactaataataaggaaaatcagaatatattttgaagtgaatgagcataaagacacagcatgacaaaatttgggggatgcagctaaagcatccttaaaacaatttagaattttgaatgtgtatattagaaaataagaaagttctcaaatcagtgatgtacattgccatctaaagaagttagacaaagcagttgaaataaacataaaagtaataaagaaatcagtaaaatagaaaacagataaaccatagagaaaattaataaagctaaaatgtgtctcattccaaacatcaataaaattaaaaatacttttaactagaccagttaagcgcacacacacacacacacacacacacacacacacaaagcacaaattacaaatatcaggaatgagagaagtcgacatcactctagattctgttgtagctaagatgacctcagtgattcccacttcttggtatgcatgcctttgtgtattccactccacattgagagagagaagaaatataaccaaaaagatactgtggaaataaccaagtgtcgcttccaacattaggccttaaagatgttttccactggatcactcactctgggagaagccaactgtcatgtccttaccacaaacaagaagctaaggcttcttccagtcagcccttcagatggctgcagccctagctgaccctccttccagtcagcccttcagatgactgcagccctagctgacatcttgatgacaacttcatgagcgatcctgagccagaccactcatataatctactcttcagttcctgacgcattgactgagtgagcttttaaatatttgttaaacatctaaggttttgtttatgcagcaatagataataccagttctatagaaagaaaataagaaaatattataagcaactttatatcaataaatatgatgacttagaaaacattgacaaattctttgaaagacaaaattgtgacataaagaaatgaaaaatcagagaaagcctatatccatgaaatcaattgaattcataaataaaaacagttccacaatgaacttcaggccatgatagcttcactgactggtgaattctattaaacatgctagaagaaaacaatacccatagtacataaacttttgagaaaacagaggaaaagagaacattcaccagttgattgcatggagcccaacataactctaatattaaacctgatcaagacataacaatagaaagaccaatatcttcatgaacacattgtaaacatctttaactaaaaatagattgaatcctaatttgattttgattttgattgtataatatagtggacttgaaagaaaaactaatctaggtatggatatcctgaaaatgtaggtgaatgtttttttctaatatacattgcttgaaaacatgattccaaattataatggatatttgacgctcagagaatgtgtccactgggagttgtgattccccctctctcatcagtgagatgagtttagccagtgaggttatatcaggaggataggtacaaatttactacttctactacacatttaatcaactcttacctgctactattgaagtatttgacttgggaactcttctcttgacagagctgagtgtaagtaatgtttgcataggatgatgatttatatctatgtagtatattcctgtagtgacaataacagcgtatacaatatcagcaaaacaatttccctaaagaaagttttgagggtaaaatgtcaaaaagtaaactccacttaaatgaagaacaaagcaggcaaaattgaattgtaatgctaagaagacttggctttctataagggtaaatttttgtgacttgattattaagttaattcaaaggtccattacggatctgggagctagggttgtcttagctttgttttttcatcatgatgaaagttgaaattatgcttttgttaacatgagagtgataacagaagacaccctcagtgtcccaagagaaatggtcattgttatctaatattcatggttgttacaatttaaactataatattccaataagatacattttaaacatgttggaaaaaaggtgagatcatctaaattttgactgtttgttttctccatttttcatagaatgatttgttaacatttctactaatatttacttaatggttggctttgattttcaataagcacatgttgttataattgcctgatcccatttatgtacaatcataacctcagaggttgaccacacacaggtagaagaggtgaaatgggagatgtactccatcctgccttctgagacacagttcctatcagcctggccccatgctgtaattcttccattaggttcacctaaaagacaaattgtcttcagaagaccacataaaaagcagaagcggaagttgagacatataacatattaagcaaaaattatctaaaattctgtgaatacacttataagggaggaaatgattgcattttgcttgtaatccctgaacagccaggtggtattgtcaggtatgcacagctatttagggaacaattagagggaaacagagatgatgaaagtcagaggggtactcttaagtcagagcttttctgcacttaggaatttcctaccacttgaaattgtttccaattcatttctaaattcagattccaatttcatgcttttctggagccatgtgaagtgtatatttttcaaaaatatttatttgattaaaggtgtctgaccctattttctttcaacagaacttgtgggtttgattctcggtgatttgagtctatttatggaaattgcgtgtatcaaaagtttgcctttcagctgggcatggtggctcattcctatagtcccatctacttgagactgaggtgggaggtttgcttgagtcaagttcaagaccagcctgggcgacagagtgagacccttttctaaataaataaataaataaataaaaacaaagcttgcttttcaactagattaggaactctgagtgcatgaatcaagttacctcttttattaaattttgcagttgcatctatcatgaactctgtatacaaatatgaaatgtgaaatataattcctcgattactagcaaatttccttctgccattaacatatattcctccttccctcgaaacaccatacattttcctttacattttttctattctccttttctttttaccttctctttttcagaaggaagtatttgaggaattctgtcctgcatcttgcttgttcctgtggtcttggtgtttgtccaagtgtgagacctgaggctacacctcacattcgcagcaattgtcctcatgtaagacacacaaaaagagacagcaagcaggattatcctagacttagtatacgtgacaagaaaggcatgagctgtaacaagtaaaaagctgttttgtttcaaaaaataggggttgctgatgaaggaatcacatctgaaagaaacaacacttttcatggaggccagatgaaaggagcttagggtcttccagtgtgtgtgtgtgtgtgcacacttgggcatactataaattagcctcagacagaggtctgctatgaaacagttaattctgaaaagttttctataaactccagtgataatgtttctttttcaggttcatggaaaaccagtttagcatcactaacaagccaccttacgggtgtagataaaggactggcgccacaacgtctatatggactaaacttttcattttcatcactttttggtaaggacctgaaaacaaaactgagtaactgctcttgcttgggatggaattgctcactgtagtctttggaaaaagaaaaggaaaggccaagaggtagcaacaaacaaacaaacaaacaacaaaatcttgcctggtttgcagtgggtctctccctgtttcctctcttcccttggccctttagtgcccagggccctcatatcacccatggctttctcgagctgttctgcatctcaaaatgggtttccatatcattatccttctttcaaagatttccccagtggctcaggcctgtaatcccagcactttgacagattaaggcaggaaaattgcttgaagcaaggagtttgagaccagcttgggcaacatagcaacatcctgtgtcaacaaaaaattttaaaaaaattagctgagtgtggtggcatgcacctgcagtactagtcacttgggaggcaggggtgggaggatcgcttgagcccaggagttcgagggagcagtgagctatgattgcactccagcctgggtgacagagtgagacctagtctctaaaaataataaaaataagagatttcctttctgtctctcagagagataactcaaatccaaaaaactcaactaagaaaattgcctgttgatgtttcaaatcttgtagaatgaagctttaaattgtttatcaaagaaatattttggtagaaaaagatccttttatattggcttgaaaataaaactgctgctacaatcttccattttctcatatctcctattggaaactggggaacaggccatctttgggaagctttgtatctttaatgcaggaattggaaatgatacaactcctaccacttaggaaaatcaacttcatgctaaacatattcaatgtctgctttgtcttgatcctgacaatcaaaattaaacattttttgacttctcagcttttgacacctcctcctgcatgagggacaacaccattcagctgttgggagacaactgtcctcgagtctcatgtgttcctgcatttgttgtgaggagaggctctaacgatctttgcttcagactatctttccaaggatattcgtatggtgaacagcactgaagggtagagatggtgtctcccaccagagcagaggagaaatttgtcttctggccagtgtaatatagataccttcctagagggaaaagggtgggcctatttgcctgcaccccattagaaaagactggattttatacgctctgggttccttggctcttcatcatccttgtgggatttgtgggcatggagaactgagaactggtgcactcatgaaggttatgaagatcatgctgtcttgtattccataagtgataaagttctttgtcaccaacccagaagtgttctgtcttttgccagaatctattaagctgaggcgggctagactgttagtttgcaaactgggtaaaatctcagatacttcacagttcttcatgccagacagttatctttagacttttccagatggcaatcaggaataaactctattctcaaacccttaggaatatacggttcaagttcactcaagaacttgtaccatgatgggaagactagatagccaagaaggaagttggaccccaccttaagccatgtgaaaaattaactcaaaatggatcaaagatctaaaagtaagagcccaaattataaaactcttacaagaaaatatacagacaaatcatgacctctgaattggtgatagattcttaactatgatactataaacataagcaacaaattaaaattggataaattgtactttatcaacattaaaaacatttgtgcttcaaagaaaactatcaaaaaagtgaaaagacaacccacggattgggagaaaatatttgcaaattgtatatatcataaaagacttgcatctagaatatataaagaaccattactactcaataatacaaggacgccccagttaaaaatcttaatgcatttttcaaaagaattaaatagacatttttcaaataagatacataaatgtataattagcacatgaaaagatgcccaacatcattagtattcaaggaaatgtaaatcaaagtaattagataccactgcccacccctttggtgaccataataaaacattcagagaatcgcaagtgttagtgagaatgtagaaaatcagaaccctcatactgtgctcgtgggaatgtaaaacagtgcagccactttggaaaacactggcagttctcaaaaagttaaacggagccactgtatgacctagaatttccactcctaggtatatatcccaaataatggaaactggtacccacatagacacttttgcgccaatgttcattgcagcatatttcacgatagccaacagatgcaaagaacccaagtgtccatcaacaatgaatggagaagcaaaatgtattatatcccttcaatggaatattattcagccataaaaagggatgaagtgctagcacatactacaatatgaatgaattttgaaaacagtaagtgaaatgaaagaaaccagtctcaaaaaagccacatataatgccatttgtatgaaatgtccagaatagacaaatatatagatacagaagtagattcgtggttgcttaagcctggggatatggggagcttggggtgtgacagggaaaggttgtgcgactcctttttgaggtgataacatgttctaaaattgtgtggtgatagttgcacaactctaaaaatgtcattaagtggtactgtctaaataggtgaattttatgatatgtgaattacaactcaatacaactgtaaccaaaaaagagaaagaaaaaagaactcacagctcactctgcttctgcacagcacaagacctccttgctactctagttcagcaagtatccacccagggacgtgacaaatcctgcagtagcaaatccactggctgagtgatttcgctcatgctccccttacatggggaagggggttaaataagcagctttacacaatcaatcaatagctctcttcctcacatcagatccatttcttgcatagaaactaaaagtagctaatggtacctatcctggaggtagggtatagattatgtaactttttgctctttttaagaaaatcttgcagataggtttagcaatcttttgtaagactatgatgtgcttaaacatgtgttatcctcagatgcaattctaagacaggaaaagtctcatttaataccctatacattaatatataataatatattgcaggtcttattttcttagtctaatattttacactaaaagcagacatgcttcaggaatagccacattattgaacactgctaaactataattttgtgcagaaattaatattatagaatactatctgattatatttatcagaaaaaggacgtttgcagcttaatttgaattttctataattttcctttttattctgtaaattatgtaatgtatcaaccccatgagcttaacaagaattctttacttagtatcactaagagtcacagctgacaagagaaattctcttaataatttgacatcagatttgatttatttttttaaaaagcattttctgattcctttattttatgaagttatattaattattagatgctttttaaatattttccacgtgtatccaaagaacaggtaattaggttgtccattattttgatgatacaattttatcatcacaaatccagatgggtcacaaaataaaattgatcctagtatttaaatattgtcagcaaaaaatacttgaataataattcaataactccaagccccttttttgtaaacattctccaaaattacattggtcgatatcaagtcttttatttgataactgctgtaggtaatagaaaatgaagaaaatactggtgagctaaataaatatttctgttttcattgatcttttaatccagaaaagaagaatgagaaataaaaatagtatcaccagagcactgataaaatgatattataagtgcattgatgctgaattacgtaatagaaaaatttgttaagtttgtaggagggggtgtagagggaaatagtagaaaaaaaggttaccgaagggtacttaatctacttttattgttaatttattatggcagttccatttgatttctttgttattcaaaaccactgttttataattttctggcccaaagtaattttggctatcttatgtgttggacagtttaaaagagtctgtagcacctattttcttttcaaaaatgcattgttatgttctggcactatttcctgaggaaatttctcattatgtctttagccgtctacatgcctaccttggtattggggactattgtttccaccaggaaatgctgaaaggtgggaagctataaagatcataattgaacctaccaatttctgtttcctatgtgagcctatgcataataataaagtagacatcccagtagctaaaatctattgagcactttctatgtgccaagaacaaatgctttaaatattagcgcatttaactgccaaaacaaacatgaggtagcactactattattttcattttatagatgaggaaactgagataccaaaatgttaagtaacttggtaaaggtcactcaaattgtgattggaggtcttcaccttgagacgtcagtaactactgctcgaaaacccacgctcataatttttccactgtattgactcacagaaattatggggcagattggctcatctataaattgtgtttaattactacacagcttttcatagctctcctgcttgtgtaatctattgccattttacaagcgtatattctcttgaatgacaaacacatgacattaaaaataaaggaagcagagaaatggagtggagagaacaatttatagcattttccaaagcttttaaaaccaagttattagatgtcgtttaacattttaaaatctccatcctttaaaatgcataaggcctgaaattaaagcaaaagatttagagagttccaaacacagagccagcagcaccatctaggttcatgttattttctttgaaagactattttatgtggtactgagtaaaaatgaaacatgatgaaatgggtttactaaaagtctgtcctaaaaatcaccactcttccctaaatccatactctcgatctagttttcattatatcagagaaaccacagtttgacttcccaatttttgctgtgaggtgaattaaaaaaaaacatattacaatacagcttttcagcatctgtgttggcatacttatttttactgcttatttgatcttcagagtgttcagcttgctatcaatgatgcatttttcacagggtttattatccagcaaggaaaaccatgcagagtttggttactttcctacacttggttcattgttttcacttttctcatgtgggacaggccttctgtggcttcacacgaaatcccttcccccagtcccgaaatgtttccactaggtttgtggaggtcattctgatagataaattgcaaatcacatggttttcatgtgaattggtgtttatctctttaaaagaagtcagaactggcagaaaattaatgaaaaatataacatgcacaggctattctttgcagtataaatgataatagcaaaatacaagaaacaacccaaatatctatattgtgagaatggctgaataaattatgatgcatccacgcagtggtgtactaagcagttataaaatggaataaaggatatctttatatactgctatgtggaattgcaagatgcattgttaatgagaaaaagcagagttcagaatagtacttacgatgtaatcaatttatatgtatctgtgtgtacacatatttgagtatgtaaacttgcttatattgtcagaaagaaacaatagacagtcaatccaaaagctaataaaaatattcacctatgtggggagggagaaaacagggattaagaggcagggatggcagctagaattctctaaataagtttattttttattttgacttggagcgatgcaatgtcttacaaaataaaaccagaaaaaaaagtaaaggaggctatctcccactgccagaaaacctaaaaccaactaaaaaaaatgttggttggttggaaacaaatcttaataaaaatgtggcaataaagtgctaaacaatgcagacaggtagatagatgagtcaatttatttttattgagaagaattatcaagaggaaataaaagttagccttttctctatatgtcattagattctaaatcaattactgaggttttgatatttgctatgaacaagatctaatattaccaaatatcttcttgtcctctgggtacagaaacaaactaaacactgtatgaaaattacaccaaaatatttacaggatgctcgaagtggaggagggagtaaatccttgttctcatttgccttccttctactgacatctcaagttctttgcttgtcagggttataaaatctgtcatgttctcggatttcacgggtttgtaacgaggatggctgcgcaagtttctcctttgtctgattgcccatttattcattcatggctgtcaaacactagtgggtggaggttcctgttcccttccagatgtactgatgaatgctttttggcttgctgaccttcttgggatttgaagagttacccatgagggtaaaactttcttccagactttgcctaccttatagaaatcattattagtactaacattgttaggggtcttgtcattttaaatacaacaaattgttcaaatgagtggtaaaatttaaatggaaaatagtgaaaatacttactagaagtagaacaaaggaaaattatgataacataaattatatgaatcatagctaatgaacagctgaagaattgctggtaatttagaagacttgaactacaccaaagacaattgtgtcaaaaccaaacctggtgtgtaaattgatctgccagtaggttgcaacttggagaatcaatcaccttagtatgtaaacctagctgtcttgtacttgtttcatcaaagcagtatgtagtattagaaagtttctcagaagatttctgaatgaaattgactagatatttgattgttcattttgaaaatgcagttgctgccctaattttcagaattttacttgatttcctccccaagacaaactgcaattgtttttgacacattttcttttccgtaattaacagaaatttgattccagttatacttagaaaatggtcacaaaaggaaaaatactgtactactactctgttccataaccattaaaatgtttaaaattttctcattttgttaaaaaaggaaaagagtgatcagttttaataaacttctttggtctaaaagggaggccaaacaaaaacatttggaaacaaaaggatgctgacagtatttagtattttagaatgcttcaaaggcatcccatgaaaagatttgaaatttgaaactcctggtacttcccataacgtttacaaattttattattagaatgcagaaatagattagtggataggatcatatacattttaaattaaacttgatttttcaaacattcaattttgttttttgatatagtataagtaatatgatcaagaaaaaaataaataaattttatgaaatataatgagcacatgattcctgaggagaaactctctatatattattggtgacgccttgattttttatatgcagtcccagtttttcatatgcaatagttcaaaaactttttagatcatgttattgtgtcttgtatcaattatctttctttgaatgtggggatttataatgctttttatttcccgtggatccctaaaccatttctaatcctgggacttatccataagaacgaaatagcaatttggtaaatgttccacccctcttatcatctaaaggaaatgggccaagatatcagcactatgcattctaagagcacttaatatagtgagagaagactctccagtcctgttaattttttatcacagaacagaaagacctaatgtgtaacttttttttaagtcagctgaaagagattgggtggtgacgatcttggcaaatataaacagaatacagatcaaaaagaacaagtgaaaggtcaattgctgtgcaccaagctgcacaaatacaatcagtgtcagggctgaagcttcacggtcagcagaagatacaggtctctgtggcccacattcacggaaaggctaatttgcaattttggggagtaacaaaaaagatactcctactggaacacttgatacaaagaatagggtgcaaactgtgtagcactatgcatctattgtcagtatagcccagagaataagattgcaggctctgaggccagcctgtctggatgggttctctgctttacctgctccgtggccaaggccaagtgaattagcccctcatttccttgttttcctcatcagtaaactaggtatagtaatagtgcctacttgacaagattattgttatgatttagtgattaaaaagattgatgcacttagtactgggaacatagtaaactttcagtttatgttatctaatacttttttccaaaaaaggggatagaaacgtggcatatttccaaaaactgttttaaaataatataggtgcaagagaaaacatggtccttattacatagtttatatatgtttcaaggatgacagactttataatattcttcaagaactgtatataaagaaatgttactatatctattgatgaaactgaaaaacataactttcattttaagagtcttataaagttatcaaaaaggacttaagttagatcttagggagatgttctcataaagttatcaaaaaggacttaagttagatcttagggagatgttctcctggtagagtgttaatccaagataactttaccaaaaggtggtttatatattgcagcaggagctactggagttcctacctacatcttggagccttcctaccatggtctcatgagaatttctgcgcaaaggctttttctggcgtgtctaggtctggatagctgatgcccctggagcagtccctaggtgatgatggataggagattggaataaataatccagcttcctcatctctggcataaaatcatttatgttcatttctttcttttaaaaattaattactttttaaaaatgattatattataatgtacatatttatagggtacagtttgatattttgacatctatgttatataatgatcaaatcaaatgtatcatttctttgtggtgagaacattcaaaagccccttttctagcaatgttgcagtatacctcactgttaatcatctttacccaactgagcaatagaatgccagattctatctaattgaaactttgtacccattgatcaacctctcttcatcctctcctccctcatctctctggtaaccactgttctactctcagtttctatgataccaatttttttttcacagtccatatacaagtgagataaagtggtatgatagtgcctgatttatttcagttctatctatattatcacagatggcaggatttcattattatttcataatttactgtggctgaatagtgttccattgtgtatatataccacattttctttattcatgttttcattgttggactctttggttgattccatgtcttggctattgtgaatagcgaagcaataaatatgaaagtacaaatattttttcaacatactgatttcatttcctttgggtgtatacccgacagtaagattgctggattatattgaggatctgcttttaattttttgaggaacctccatatagttctccatagtgacttaactaatttacaatctaccaagactgtgtaagcattcccttttctccacttttctatactgtctcccagaggtctgaagaagtaacatttttattatcatgccctatattaacatctttccgttttctgtttcatttctctatgctttacagttctttcctgagatcacctcccaaatccacaactttcccttttcatccttttctcagtttctgtttctggtcgaaccctaaactaaaacactctcctcttctgatagagctgtagcaaaaattatatgtaaaaatgcttttaaagtgacttgaggggtgttctctcagaagcagggagatagataaactacatggcatttaattgttatcttatgctatttcattctatttccaaatatatgaccatgtgtttttacactcattttaatgggaatttatatctcccattagatgtgactccacaaagaaagggaaaagatgtctggctggcaccctgaacctctaaattctctatcagttgcccaaagtagttctgagtgcacaaaaatataaagaagaaacaatacaaaaaattgtgttaattatcttgggtctttggcctcgaatcctgtgtggagctcttggatcttgttagccaagctgtgctggcttctggtagatagataccctgttattttattcacactcatcttttccctaaggaagaaaggcaagggttgggattgttcagattccagagtactaattgaagccagttttgctaggggtagtgacttatatgtaaagaaacattctccatttttgatctgggcaggtgagactttacatttcattctatggtgatttccaagacctggtttgagctctgggagaaaaagagcaggcattacagcttccctgattgaggaatatttagatctaactaccatagaaaaataaaatccttccacatgatgcaacctagctcattggggttctgctttggcacaaaacccagctaacagaaaaatactatattttgtactcagccacagttgtgtatacagggccttttgaggaggaagtgttgccaggcaaggcaggaatcaggggatttggggcatcctggagtctttctcttaatagccctcccatataggatcgacttctcacttgctgaaaacacgagagtcaaggtaacttcatttgtgcagatgaggcagaataaggtctagactaaaagtagtctctatttactccttccttttcatctacattcaaaccttggccaccaacaacccactcagatcacaagaggcaaaggaaataaacctaacaaaaattacaccaagagaatgagaacgttttatactctaaaatcaagaggatagcagataccagcttcaatgatccatcttttggcatttctgggtgctaaaagggccagattctcaagcagtagtttttgtcattcattccatctgtacttattgagtatctactgaacactagaaatatcacaatgaaaagaattataaagtcaagtgcctgccttaatgaggcttactctgaactggctgtgtgataataacaaagtaaagaattgagaaagaaaagagatagaaattcctactccaggatgttgtttcaaatataaaatattatttttaagcagaacccacaattatgaatgtacattaaaggcttaaagtcattcacatggcaaaaagacataaataaatctgctagaggcttccaggagatattcctagctcatgacacagtcatggaaagcaaccctgtttctcccacttgacctgcgtttattgttgtccttcctagagccttgaggtgaaatcacattaggatgaatccaacacagtgtaaagaagaagaaacacaaatcatctcagaccttacagacatctttgttttgtgagattaaatgattctgaagcctgtactccccatgggttttcttgtatttgagataccatgaaccaatgttataggggttcctgtttcttttagacacaaatatgttaatggaatagaaattgatattaacagtaggttcagttaaagctcccaggaaactggaaggtatttgagatagacgacttggtcatctggagttgaaacagtagcgtccatatagtattgaggtatgggggtatagctgtccatggcatgccacaggaaacagctaaatcaaatatcatccaaggtatcagtcaatagcaagggctgaagggactgagtagccactgccaaggaacagcctaaagttcatgggatagatagctgcttctgttcacactgaatagattagagaccacaatgagcttggacagactaaacatcaagcgcttcctatgactgctaaatgaatcctcatcttttcaattgcagaattgaaatagctaaaaagcaaatgtactttatgtttctgcggagtgtggatttccacatcaaatgactttataacctcagcagaaaacttatgaaaaagttagggcaacagttggtaataacagaactcccagaactggaatggagttacttaggatgacatagaggactaaaagtaacccagttatttaactccagggaactttctatgtcagctaaagtaacccctttccactttttaaggagctgttcttgccttgcttacagactcaaaatatcactggctggagggaattacatttcagtgggaaacctgttaaccccatcatagtgttttgtatccaaatctataactaaattagatctcataatactctgggggtgggggtgggggagagaacttaccaagtcaagactagtaggatatgacttacccaccaaaagaattggagtaattttctaattcatatcagcaaaaatctggggaatataactgtgctttctagagcaaaaaggaaaaaaacaccttaattttaaattgggctgaatttttctagatgagagccagaattctgggttcaatgtgacttcaacagctggaagtaatgataattgtttggttcagtgactaaaatatggtctcaggtggctcttgctaagtcaaactgagaaggcaaaagctttttggcataacaccagtaaaggaatccaaagatattgggagataaaatgtgatggagtaaatttaccatatgtggttgacttctccccctaaccctcactttgacccagagagggctctgaagacagaacattcatcaatgccatgataactatcctgctgagagaagtgccagcatgtcagagatctttcctggctgtttatgagctagagctgctggaggagatgttgcagttgaaatgactccctgatttcaatggataagggaagttcctggggtgacagaagccaagtgattacactctatcaccaaaagcaagatggatgtgattgttacaattgacatgaggcactttgtcataatcagagaggtctgttctgatctgcaagaccttttatggtggatagacaatttgggatctctaggatgaaaacagatggtgagcccattaatgtcctacttgatttgtataactaggaaaggacaagtcaggtgaataaaggtctgctttggacactgcaatagtggtaacccctcattcaatttccaaagccttttgagtgaagaaaagtccagatataaggaaaaaaaattgcaatagcagcccaataatgttctctgggctctgtggttattattattattttttaatgactatgcaaagggacagggaaacactcagacctttatggtcaaaagattagttttaatgtgcctaaggtttcttccttcaggctaggtgactgcaaatctccctagaaactgctatagccacatgtttataataaacattcaaggccagtagaatactgagagagtgtacttaggatacaagttcttgattccaagcccctgatcaaactagaggaaaaacttggaggccaagaatttgctttcttttactagtttaaatgtaagacttgacccctaatttttgatcatcccaggggaggaggtggcaattctccaatcatgcagcttaaaagtcttgaaagccaaaggttaggatgcttctctgagtcaaatgttgcatcctaaaaggtccatctgcattgttctagaattgaaagggccacagatgatcatacacttgcttttgtctctgtgcatttctccaataaatgccgtctcagaagacctagtatatatgctattagatcctttgcccttacttgtttgacagtggtttacccaatacgtgctttttactaatccctgagatacagaactccagtgattacaggtctaacatgagtggagttaatgaggttcatgtgataatagaattttgacaagagttgacaatctagttcataattattttgtcagttactgaatgcaaaattaaaatacagccaatccttactattcaaagatctgtattgcaaattttctgctcactaaaatttatttgtaacttggaaatcaatactggcagcattttcgtggtcactcatggatttgcagagcagcaaaaaactgagtcacccatcacgcacattcccagctgtggtctgaccagctgatgctctgcttccttatttgagctcatacagagttgaccagagggtggagatggtggggggcagggcagagtggtgcgagaagctatgtctctggggacagttagttgaaagtttgtatcccaactctgtaacctgttgtcttaggcaagtctcttagttttaaaccttgtttttgcttttgtaaaataaagacaacagaatctatcaggatgagttgtttctagaatttaagattataatctctgtcagatatgtacatgcatattttccctaagagcaattattcaatctccaataatttggtgttggcactttatgaaacagaactaccacaaataacgggcatcgactgtagatgtttccatcaaaagacagaaattcacatcggttccttgaccatataaagttgaatgataatatcgtctacctcttagggctgttgtgaggttaggtgagttaatatattgctcagtttggctagtgatgaaagacagagttaccacagagaatgacaagagattagcagaagtgtaattaagtagagattcaatattgcagttttgtagaagatgtagtcttttcattggagcaaatcatatagcccttggtaagtatacattgatttgaaaaatgccctttgatctgtcccccaaagcaggaaatagcatgggaagtttgtttttcatgtgtaagagatagtagtacatcttcactcacttgccactgggttatttcaactctccaattctgtgtccgcttgtcattcatcagggtcaagtaactatgtgtgaacacccaggacaatacactggacactttgctaatgacaccatgtagacagaaaacacagcagagtccctattaccttgataagacacccagatgccgtggtctggaaaacaaatgctccaaagggtgcaggaagctgtacttccacaaggttgataacggtcttgtggtctaagtatgtccccttcaaaatgaattttttagaagatcacgttagttttgaaagaaacagaatcaacaaacagtgaatgcttaagtcaaagatctcacatgaccacgagaccatagctgtccaatgtcaactcaatattatctgactcattgtgttataaattctgatatatatagtggtttagttttatgtttagtaaatatgtgaacttggataagtttcttctcttcccttcccttcccttttttgaaacagggtctcactttattgcccaagctggaatgcagtggtacaatcatagctcactgctgcctcgaactcctgggctcaagtgatcctcctaccttagcgtcctgagtagctaggactgcaagtatgcactaccatgcctggctaattttttaaaaaatagtttttgtagagatgggggtctcactatgttgcccaggctggtcttgaactcctggcttcaagcaatcttcccactttggcctcccaaagtgctgggattatagacatgagccactgcacccagccagtaagtttcttttctggtttttgtttccacattaactagaggttaatgataataaatatctctcaatgttgttagggcattcagtggattagtgcatgtagtgtctggcacttagtaatgcttattttatttagggctatcgttctttttagaataatagaatctgtcctttttggaacaggacctgtaaccctgcagaacccagagttgcagggccaggaagcacaaagtctcctgacggatgattaggaatgatgatgatttactcctgcttctactgcacccaaattgatgtattcttcatactagaggccatagtaccatataaagttttctaattcattttacataatgcatcctggaagatgggctcccatcctcacagagtattattactctcgagctggcacttaagctgtgctttctgttgtttattccaatgcttgcagaacaccttcctgatctagtcctcattcactgcatggatgggtcagagcagttttcccagcgtatggaatgtgttgtctccataaccttgagagctgccaagaattgtgctttcctctctgtgataggcaactcaagatgcaataatttgccttctactctgaagggagagttccagcatatcctcgaagctggagctgtaaaacccctcctgaagtggcaggtctaggaatcttcatagtcttaacagggccttcctgctcattctgccagattagcatgatcccatgcataaagtggatcagtgcgatgctttgtggaatgcatagacagtccagatctctttggagactatattacaactgagattgagatattacaactgagagtgagatatttaagaaagccctgggcaaactgggaatgtgtattggtttcctttctaagtgaagaccagtggtttctgattgtctttgttgacggggaaagagaagtatgtactagataaataactagatgtaatgccatgtagctgcagccatatgtatctgctctagcaaggataccacctctatcatggcagctgatcagcctgctacctgaagtaatctataatcatccttcaagtctagtcacttctggcaggggccagactcacaaatataatggagctataatagacacaccaccaaccctctattatttagaaacattttttttttcagacagggtgttgctttgtcacccacactgagctcaagtgatccttctgcctcggcctccccaggtgctgagattataggcatgagccactgtgcccagcctatttagatctttaagagtgttattaatctctgtcatcctttctggcatataatattttctatttaattgccagatttggagggggacaatgaccatacaggccaagagcccaattttcaagtaagtcaatcataattatacatttgcgaactttgaaaaagaccattgtggggatctatagaccaagcaagaccaagcaagaccaagcagtcccactgtaacctggattttgtccacaccttcatttattacttgaaccttataggcttccactcttaacagggggtcccctatagggaaggacattgcctgtgtgtggggacagttggtatatgggaactttgtagtgactgctcaattttgctgtgagtccaaaactactctaaaaaataaagtttattaataaaaaagagagagcctggggaatcaaaatcttaaggggtatctaccaacatttctgcattgcacgtgtcagggtccacaaccagggccctgaggttgacagaacaaactggcttcagctaagccttcagttgtctttaaagattagttactataattctacaacctaagttttgtcttaaatttttttggctctcccatgatagaagaaggacttcttttctgctatgaaggaggcactctgccctttacacttggatttcaattgtttattaagggccattaagttttcattaggaagagcattgttatgacttaatgacagcaagccagttccactctctatgcattgtttctgtacttttagaaacaccaaagtgtttccttctataagaatagtttcccaagtggctactagtgaatggctagaaatgactctgcctccttgtgccagagactgactattcatgactcacgtaccacatggaatgatgtcttcattatcagtggagtggccagcaattcagtcctggaaccgcatctttactgcctaatttctcagactactattggtgtcggttgtgttctctgggaaacagatactgggccagggataaaaaactgaaaaaggatttttgtgaaaggaaaaggaaggaagcaggattgtgtggaaggaactgttagcctatgaggcagataggacaaaatgtttgccagaccaatgaggagctccagggcaaggtcgacctgttagagaggttctgagttgggaagaaatagagaagagtttgtacctcagccttgctcagtcatcacctgaggtcatcctgaaaaagggtggcctggtaatgaaacagaatgatgaggcagtttctaagaatggagtcaggacaattcttccccagtagaaaaatatttgtatacattattttcagttttgcctttttaaacttaacagcctcccaaagaattttccaagatccacagaattccatagtcatcattactataattttaaacgactgtattatatgatatctggtgccttaaaagatactttaaacatggtttgaatgggcatttttttttaaatgaatttcctggtacacaggcatttggggaagtaaaaaagacttttttttagtaataaaatgactttcctttttatagaaaaggcaacaaaaacatagggttaaaaatcatttataatataattcttctctgtgagactttaccattctcattgacctttcagcctgaatgcaaaaaaaaaaaaaaaaaaaatagaagactttgtcacagttttagactgtagagctatttttagctgtaaaacgtcatgtcctaaacttaataaaaatcaaacacaaagagatgaaagtgggaaccttcttacagaaattcctttagggctatatcctgccttcattctacatgaagaattcccacagaaatcaatagaagattaaaataaatatcaatggcaggatacagtccaaattatgaatgaaaactttaaacttgacaggttaattgtttttcagatgactggaatttggggcagcattttcaagagtgaaaaccaacattttggctgcagataaattagtgcacagcattttgtatagcaaggccttatctacggagttatgtccaccctttgttttaagacattggtttttgctatttgaaagggaagtttccagaacaagcatcatgattttccattaatgggtcaggtttccactttgcctttattttaactaggacaaacaatatgcaaagtgaaagaaattcatttctaatactcattgcttagccacattattttaaaagttagcaagaaataaaatataataacattacaagtgaaagatttaaaggtaagactgaatagtaagagtgattatgacatccattgcctacaaaaattacaatgggtagacatgtatacatagtgttcagagtatcagtcttatcatctagaacacttgaatagaggtttatggagaagtcaaactgcatttcttaagctttgctgacaccatataacaaatgcttggccttgggcacattagctgctctgagtcacttttttcttttcttttcttttcttttctttttttctttcttttttttttttttttttttaaaaaaaaaaaaaaaaagaaaacaggaaaagagtgcccttctgtgaaagaagaatggaagaatgagcttcaagaaagagcagcataaagatgcaagggtttagttttgtagcataactagaagtcaggggctggtcagccttggcatcggttcagcactccagctaacagggccagctgccctgagagttttgtctcctttcctccactttaccagattatctgccacagctccaggtatcacatctttgttcaagcctggtgatggagtaaagaaatggtatcattaataactaattttgttttcaagaatgtatagactctcccctgcatctatcaacttatatttcctatctagaattgtaccatactaccagtcttagctacaaaaaaagaccagaaatagagtgggacggtcgggcgcagtggctcacgcctgtaatcccagcactttgggaggccgaggtgggcaaatcacgaggtcaggagttcaagaccagcctggccaacatggtgaaaccccctctctactaaaaatacaaaaaattagctgggcctagtggtgggtacctgtaatcccagctactcgggaggctgaggcaggataatcgcttgaacctgtgaggtggaggttgcaataagccgagatcgtgctgctacactccagcctggcaacagagtgagactctgtctcaaaaaaaaaaaaaaaaaaagaaatagagtggaatatttttggcagaagcaaaattggactgtataatccctgatataattcttttaattatttaagtcacttatcaaaattgcaataatactttgaataaagacaggcatagagtagaagcccactcagctatgtgaggtcaatgaacattcctgttttgttgacgcctgcaagtccactgtgggagcaccactgttatgcgtcagagtggttggcacaatgttggccaagaaatgtaagtggctgaatcactaataatcatttcaaagaggcaattcaattcaattaacattaaataaatgcttattatgttcaaaccatgtgctaggagcttggattcaataattgtaatactagatcataggtattaggagcttatttagagatttaaataaagcactccagaaatataaagtgatggtaattattctctgctggtagattgaagaggaacatagagaggaaacctaaaaggaaatgattcacttctaaagtggtaatagattacagtgacagtgacaatacttcacaaggtaattcacatttacttggaattgagagaaaagactaatgaatgaatcttctggtaggttgacaagagtggtgggttttgattacttaaaaattaaaaggagagtatataaaaggacttctttaatgaaattaaagaattcctgaatgaagataagagaaatactaaaattaaaatgagatgtctatttcacagggaagaaagagtagttgtttgaaataaaagcaaagaaaaacaacaaaacaatacacacacacatacacacaccccaaaacataaaacaaatttttttttcctgtggggcccaagatcttgaacactaaaaagtggttagaattaaaatatttgtaaagtactagtgaaacaatgatagtgtcattgattactgtttaaaaagttgagcgcagattgaatttattatcaaagaaactgttcggactgctccaaaataaatcaatgtgcttccaactttaccttaggtagaacatggtctgataaaaaaatttttcccatattgtgtggagtgaaatccttgatctaaagcatgttagggttgctacattagtttctttattctagtttcagtaagtattttaaggtgattgagaaaagaagatctctgtgagattaaaaacctgctgtgtagcccaaggaatgtaacgttaaataaaatgtcagaaagaattcactgtacatgtttgagcttgtagactaactgtgttaaatggatattaaactgagaaaaaattcttttaatatagccaatacatgagtatattagacagttagatcagaatgtctatatcagaaacttttattgaatacgtattcattccttttctctgatgataagagctaatgtttacggagccctgtttctatagcccagctattgtacgaattacgttgcgcattttctttgttaattttcacagcaacctaacaagatagaaattatttttaattctcttttagtaatgagaaaactgagaagttgccgtttgcttctggtcacatagttagtaaatagaaatataaactggatccaggactcctcctcaccttaaccaccctgtctctgtaagcaatctactattcctattgtttgggtcacctggtatgtccaaaaaaaaaaaaaaaaagaaaagaaaagaaaagaaaacagaacttggatgattagcatacccttcatattaacatttataaccatatcttattttagctattaaatgaaatttaaactgaagtttcagtattctcagctctgttaataaatgcttcctttaaatattaggtataattgcatagccagttcctaccaatgagtaagtttatctctggcaatgagttgttctcagtgtccaaacacatttcgttaattttgctagggaagtattgaatttgtctgtgttatagtgaactgaatgtaagaaatgccttaaaattatagcactcaggtatgcttccttttaaacattctgtttaaggtttaacctttttttgattttccttcttgaaaagagaatgttcatctcctaaagttatagacgtaattattgttatataccacataacaataattttttgaaattaaaaaatatacaaatacaagctactccattaaaatagaatctatgtttgaatactattgtcatttttaagtgtactatactgaaattatgttgatagaaacacaatctttttttcattagtaactgcttttatggtttctacaagcagttctccatccacattgagtgtggtcccagggaactgtaactagtcttggaagtgattggtgttgcctgaggatttggggcccagaacaaagagaaacagagatctgagggaaaaaggagcataggctggaagctaggaaatgtctgaaaaggtaagtctataaaattagacagggcacacacagaagcccaagtaaagtttcttacagagtatctgtgagccagtttggaaagttgagcttaaaataatcccctggagcatatgatatggggtaaggatcttttacagcttggcaggaggacagctaaatgctcggagaaagatccattgcagacacttaaagttattgaagttctatttgcaaaactgagtccctcaacagtggacacttcagttaacgggataatttaaccaagaaagagagtccaaaataattccttaaggactgatataagaaacttttttctaaggcgataaaaccagaatttattaaattgtaccatggacattctacaagcaaatctaataagaatgttgaggtttttcttttttttaaacaacagtgtccacagggacctttattccttgacttcaccttgcccctagatccaaaattcatacaaattaattagtgaaagctgacaagacgtttgaattaccttaaaatggcacattctgaatttaaagtaggcaagaagatgacccgacacttgcctaaagtaatatactcactaattgcaagcttgacagaaaaattgttcatgggaataaaaatatcttaaggaaatttctttatgatgtagctatcttctgggtaaaacatagtgtgaaattctacacctaatcaactattacacagtaaaacaaaatagactttaggacccaatattaacagtttctgtacactgggttcccactgatatcagatgctgtgcttcaccttgcctgcgttatcccacttgatccatacattagccctccatcgttgctgctactcctaattatacaaatgaaggtgaagaaacgaatgaagaaacagcccccaatgaagttaagtgatttgctagacttgggattagaatccatatctgcttggctacaaagactcaattttttgagcccaggatgcatttgcttattaattataccttttctcatgttatttgttgttccattaaccaagaaaatatatatcccaaggcggcatcttatcaacactgaatcacatatcgaattattcatgacaaaagtgtacaattaaaaggaaaaattttgtatgatttcctttggatacttcagactaaatccttgctgttacttgatttttgatagaagtattggttcccctgggatgtaacacacctgttcttgtgcaggtcctaaacaagttgagaaataagatgaagggtaaggtatatggaaaacagaaaatattgttgttttaactgataaaggccaagttgtgagggccaaagaggtttggtaaataaaccacagaattagtcagacttaacttacctggtcaaggcactgacagccaccagtgttgggagcagcctgctcccaagaacaacagggaaagtctataccccagagccaagagctctcacaaagaaaatggtacccggctcttttttttgaaacgtgtccatcagataaatcacctcactcccagagagcagagtaaaggggtgaagaaagggtgggttttacagcaatagaactgccttcagaagaagaaaatttcagatctctttctcacattctcttgtacctcgctgggtgtagcttccaagcctctggttagatctccctgtgtgggagatcagcagtccaggacagactgcctaccacacgcacagggggattgcttgcctccctgcaaggatgaaaaactagccctttaggagactcttggaacctctcatgggaaagacacatgttgccccacgaagactctgaaatgagtcttctactccattaattaaatttactccagggctactttacttaagcttccaaatttactacctattccctttcccatcccaaattatgtccaagcatgttttcctgtgtaacatgtcattgatcctgtaataagatttaatgacattaatgaatagaataaaatacataaattctataatactaaaatgccagaaaactttcatagaagccctcttctgctgtcagattcagagggagaaagtaaaggctatgcctattaacatttaaaggaaattaatgtttaaaattcatttttagaaaatatgagttaaaagttagaaattaaagaaattctcatttttagaaaattctgcttagtctatactagaggttttctcaattatttagatgcataagaatggctgatatttctttaggacctcatacattttattattttaacacaggtatctgataagtctctttttagaatccaaagaattaacgggacacaggagattataacgacactctccccacatataccaactttacaaaaaagggtttaggacaatttcccaggtgaaaattcctgaagctgttatttaatattgactgaaactgtagtaaaagctcagttatatttctaagtaaaagaaggcatattaattctctactgctgtgtgacgcagcaccccaaaatttcttagcttaataaaacaagcatatattctcttgcattttctgtattttaggaattggggagcacattttttttctggttggttctcgttcagggtccctcctgggatcgcagtccagttgtcctcaagggctgtagtcatctgacaccggtaaggttcattcccacccttacccatgtaggcagcctacagtttttcaccattggagagagacctcagttccttaacacatgagactcttgactcctcatggcatggcagctggcttccctcatagcagtgatttgagagagaaggaaagcaaaacagtgatgtcacgctgtcatttatgtcctagtttctgagtcatacaccatttcttctgccttcctctatttcttaggaatgcgtcactaagtcccatgataccttcaatggaaagcattacacaagggcttaaatacctagaggcaaggaaccctggggaccatcttagggactggcttccaaaagaggtgatggcaaaaaaaatcgtaatttttaccctcaccaggatgccactggttggttggtacaaattaagcagaatctatgatttgatcatttaaatttaatagagggaaatcttcagcaaaaagtttagtacagttcactaccatctcttagagaaaaatctgcccacgcacagcttttagtgtccatctcctctgggacctctgtgttctgggtacttctgctctgtataggcaacgagctctgttgggtcacatagctacctcgtatcttgtagaaaggcatttttattcccgtgccatcatagctaattccactgcctcttattagagaactgcttagacctaagaaatttgctttttagtgatggtttctatcttgtctccatatctgtttcaaccggaaaaacttttgcaacatattcctgagatgaaactagcataggtggttctgaagccagtgttccttgggctgtgatgtggcccaaggtcccttccgtgtgctcctcagggcactgtctcttcactgcttgtgaattctacagtttctcagtcagtttccttcataataaaggaaaccaatgaaagtccccctacaataactgtatcaccttgaaacacatctagtatttcttttgagcagtttccacttgagtctctgaatgagcctcataaattcaccatcattttcttggccccaaatagagagagtaatcaggggctgttaattgctgatctattgctgcctacccaagcctgacactaaccatttaaagacagaatgtcagaagtagcacagagcacacacgaaacccagctgccttgtagtttaaagccttgtagtttaaaaacaacgatatcaagttctacaattgtacagaaaaacttgttctctttatagtttaattcttgcctcagctgcccttgagctctaagacctctgcagccactgacatctgttgtggtttttgctgtccacataacatatgcaactgtatttcagggtcaggaagcaacaagctccaggctgcctgtgcctgtgaaaggctttcactgccttgagcatctttgtcaaggaccttctagacttagctccgtaagtcatagagaaatattttgtcatagagaaatacaccgtaatctatattcatagatccagatcagaatattgtgtgccctgcgtcttaaaggtgctggcccttgccatgatatttaaaagctggttcagtatatgccataacaaacttcaaaatattctgctccaaaacccgatgaagactccaaaccacatgtctttgccccaattaaaagtctctccatgtgttattttctttttctcctcagctttgctcattgcatcttatttggcagtattcccatcaaaatacaccaaatgttgtttcctttaaggtaatccctcaaatttgcaggtccccctaatgatggcggacctgcctgcagaaagcagtagtgactgtgctctttctgccaaaggctgagcaccaaggagatgaatggaaagcagctgagctgaacacgccccatttatcttcccaaacttaccaactagaaaagatactccaatgtggttgtgtttgatttagggaaagtgcaggaagaagtgcggagtacgttacactaattgaataccctccataggaagaaaacatcaggagtgaggagaaagttttgtcttttaactacgtgactgagaggctcttttaggcttgtaacggagatttaaaggagcaaagcatttttttaccctaggagaaggttgagtattcttgtgcaagtgtagctattgctatgtaacactataatatttccactgtggaatttggggaagagatagacacgttcaccaggacagagtgaattttgttagaggaatctgctcttcctccacacctgccctctgcagtgcacctcacagtgatctgacttcagacccctttcgttccctaaaccatcttgcttcaatgtcaacagcgatctcctgagggccaaatccagcaaacatttcccagttctcctccaacgtgattgctctttgatatctgaaactatgcttttggaaatcgttttcaatgtctctttttcaaaactctcatcttccttggcttccttaaccctgcattctccagggtcgttagctggacctctgaaagctcctctcctttctcctcttctaagacatcatcctttgtgcactccttgaacaaagtaattccttaggtgtctgcccccagctccgctggcatctagttgtagactttttaccttggcaatgtacttttggctgtggtttctacaacaatccccatgaaagtaactcggctgtaaatgaaactctcaactttctacggaacatacatgtattttcaatattcaaagtaaatatgtccaacactaatttttttttatcagaacttgctttcctttatatattcatttcctcagtcaatcagatcctcattcttaagtcactgaggtcagaaattgcctggtcacatagtcatgttgaaggctgtttatcttagagatttgtcatgctctggaattagttagatctaggttcaggcccagctctgcaattaccagctatgtgatcttcagcaagctaccgaattcccatcccttcccttatctgtaaaacagacatagtaagcagaacgcacctcacagggctgttaaggaagatttaatgagataaatgtgcatggagtccttaatacactggtggacgcagagaaatctgatatttacctgttattacagtgtttgttgtaactctggattgtctttaaattatgtgcccttcttttatatctgctgccattaccttatttcctttcctcatgtgaattattgcatccgactagtttctttgtttatagtttctcaccctttaaatccatcatttctactgtcacaaactttaccttatgatagcccagacctattcatgccacactctgctgctttaataccctactggctcctgttagtctacaaaataatgttcagtccctagcatggtagccagggcttttaataatatgcttacaacctgctttcttcctcacacacttaggctgcaggcatgctggacttttcactgtccctgagtgcactttcataaacacatgactttttggcaaaaaaagaaaaggaaaaaaaaactctcagcctgaaattctctaagctgttcatgctgcaaatatgaatgaaaatttttttcttttctacttgattgacaaattttatcttactgtcctcgtgcatgtatacattcatatacatacacaatatttatatttaacctcataacagtggtttacttgttcatgcctgcaacaacgttttaagctccttaaaagcagggaccatgactaattcttcgaacttagtcaccatatctagtatggccatagtggatgattagaaaacacataaggaaatgaacttgtaactctaataaccttctaagttagggttttaagattgtggattctactctttcaccaagttagcttatgttttgataagtatttgcctctttaatatttcgatggtactgtgcaaggaaatccatggcctgttaacagcagctggccatgttagcttgcccatgaagaacagagaaaatgtgggaggcaatacggtgacagtggtgtaattaaaatgttaaaaattaaaactgaaatgtaactgctagttataataagtaaatagatcaacataagatttttaaattaaagtagcaagaacagttacagcaagagtccagatggacagcgttttctgaaattactataggtctcacataccctgagaatcatcagttccaacttttcttagagacaggtacagttaaaagaaaccctactttatttaatacaggtaatcaacagatagtgttcatggggttctgtttcacagtctcatttatttcttggctttattgaagttttaggccctatgtgagccctgttaagttaatgaacaaaagcatccttttctagctttagtaaaacttgactgtaggctatttcacagtgaacacttctcagattcttaagcaaggtgccaatatgccctacaagacttttggagaaaattaaggaaggcatctcagtgtcatgtatccgaactgttccaagtgcctcaaaataaatgaaaactctatccacttggttaaagcacaatttgtccatttaaatctctgatcttacacagctagtatacccatactttctcctctgcttctgatgtcctcattgtaagacctacccacaaatataaatgctagcaaagatgaggctttctgttactatttcaaataaaattgtgattattttcaaaatatgaaatcccttctcattatataaaaatttaaaaatacaaaaaagaggaaaaaattattttatcatccccaaagatctgttgttcgtattgtaatattcctagattttttctatgtgttttacaaactttttatagttatgatcaaataaatagggcactagagagttgtgtccttattttgtcatttaacattataacaaatttttcatgtaaataaatcacttataaataacatttatcagtttcaaaatagttcatcatgtggatatatcatcacattaaccattcccttattctttgtgttaaggtttaagctatgattaataatttcttaagctttgtttccgaaaacttttcttcatgagtaggacagggagagaaaatctattgtttttgctgtctgcatgttctcctagctcatggaaacagattcccacttcctgaggggattgcattccattaccttattgaaatcaatattagccatgcagcggagcacatgtgggcatgatcttcagagtactacatttttctggaaactgtcaatggctcagagaaaggcatatgacctaagccaggacaatcagtcttttccaggactgtttggctggaattttcattcaaactgctaaaccagtaattttgttcattgtttgagggaatctgcctgaataatggacaaaaagagctttgaactacatcatttaagttttgccttgcctaaaatgtactccatgtcactaacttttcaggtatttgctctagttttttagtttttttagcctatgctagtttcagtttgaatactattgcaagcctgagaccatgccaactaataaaaatgaaatctcctcaggatgtcagcaagatagctgaataggaaaccccagaccttctttcgtctcggaagcactgatttaacaacagcacacggatcaagtccctttgcgaaaaatcaagggagcagttaagatgctcttgtaccctaggcaaacacaaaaccaactgcatcaaagctggcagaaaaattaaagagaaaactcttttgccatagtccctccccctaccacaacaccagcatatacaacaaatgcatagacactaacacaaagttacaaggaacacaaagaaatagaaagtatggcccaatgaaagaaagaaacaataacaatctccagaaactgataatttagaaatggaggtaaacgaattacctgaaaaggaattcagaaaagctttcatgtagaaatggagaaataaatctataggccaatatctctgatagattttgattcaaaaatccttaataaaatactcacaaacagattccaagagcacatttaaaggatcgtagaccatgaccaagtgggaattatctctgtgtaaggatggttcaacacagagaatcaatcaatttaatacaccgcatcaacagaattaaggataaaaatcaaatggttgtaccaatagatgcagaaaaacatttcacaaaattcagtacccttttatgataaaaacactcaacaaaccaggaataaaaggaaattacctcaacataataaagaccacatatgaaaagcccacagctaacatcacacttaatagtgaaaaactgaaagttttttgtctaagacaaggatggccactcttgtcacttctattcaaaatagtagtggaaatactagtcagagccattagataagaaaagaaaagaagcacctaaattggaaaagaaaaagtaaaattatctgtgttcataaataacatagtcttacatgtagaaaaccctaacaattccatacaaaaaatgtttccactaataaattaattcagtaaagttacagaacataaagtcaccatacaaaattaattgcatttctatacactaagaacaaacactctaataagataattttatttgtaatagcattaaaagaatacaatatttaggaaataaccaaagaggtgagagacttgtgcattgtaaactgtaaaactgctaaaagaaattgaagaaggcacaaataaatagaaaggcatttcgtgttcatggttgggaaaactcaatattgttaaaatggccagaatacccaaagcaatatacagattcaatagaatccctaccaaaatcctaaagatatagaaaaaaattctaaaatttatatggaaccacaaagggcctggaagagccaaaacaatcttgacaaagaaaaaagctggaagccttacaaatttgctgaattcaaaatatattacaaagctacagtaatcaaaagggtatgatgctggcataagggtagatatatagatcaaagcaatacaatcgaaagcccagaaataaactcatgcatatatgggcagctgatcttcaataagggtgcacagaatatatgatggagaaaggataatctcatctcatcaacaaatagggttaggaaaacaggatatccatgcacaaaaaaatgaaattgaaccctaactttatatcatacacaaaaaatcaactcaaaatggattacaggcttatacataagacctgtaactgttaaacttttaggaaaaaaacataggagcgtcttcctgacgttggacttggcaataattttttgaatatgacatcaaaagcacaggcaacaaaagcaaaagtagacaagtggggctgcatcaaactaaaaagcatctacacaacagaggaataaaaaggcaaccaacagaatgaaaagataacctactgaataggataaaatttttgcacactatatagctgatgaggagttaatatccaaaatatataagaaatttaaacaactcaacaacaaacaaaatgagtaatccaatttaaaaatggcaagaggcttgaacagatatttctccaaagatgacatacacatggccaagtatatgggaagattctcaacatcattagccattagggaaatgcaaatcaaaaccacaatgatatattacctcatacctgtttggatggccattataaaaacaaaaacagaaaataacaagtgtaggtgatgatgtgaagaaattggaatccttgtacactgttggtggaaatgtaaaatggtgcagccactatggaaattaatatggaggtttgttaaataattaaatatagaactactatataatccagcaattccactaatgggtatttattcaaaataattaaaatcaggatctcaaagaaatatttgcactcccatgttcattgcaattttattcacgattgccaagaggtggaaacaacctaaatgcccatcaacagctgaatggatgaaagaatatgtgtataaacatagaatgaatattactccaccagaatgaagaaggaaattctgtaatatgctacatggatgaaacttgggacattatgctacatgaaatgtcagtcaaagaaaaacaaatgctgcatgattccatttatatgaggtatctttaaactcatcaaagcagaaaatagaatggtgtgtgctaagggttgagggagctggaaatgggaaacttctgtttaatgggtataaagtttcagtcatgcaagatgaaaaaacatctagtgatctgctatacaacattgtgctatagttaatataatattgcacacttataatgttatatgataatataataatatcatattgcacacttaaacatttttataagaaggtagatctcatgttatgtgattttttactacaacacaaagttagatcttcccaccacatttaccgatacagatatgaatatttgtgtttcttcataagcctcatacaattgctatcccaaagtcttgtatcaagtcatatttttgttgttgttgttgttgttgagacggaatctcactctgtcgcccaggctggagtgcagtggcgccatctcggctcactgcaactccgcctcccgggttcacgccattctcctgcctcagcctccggagtagctgggactacaggcgcccacaccacgccaggctaattttttgtatttttagtagagacggggtttcaccgtgttagccaggatggtctcaacctcctgacctcgtgatccgcccgcctcggcctcccaaagtgctgggattacaggcgtgagccaccgcgcccggcctcaagtcatatttttatagcatgttaatggaatctcttatgcttcatccatgttgaaaatgagtattttcatttttaagtgttgcttgtattttattggccaaaattatttcactgtttatttctgttattgaattacctgtaaatcttataatgccttaataggtcactatttttgtctttgtctatgggggggttgatactgtaggggaagagcgaaataatgtggctcctaaggaggaaagtaattaagaaaattcctactgttttaaacttgaatctctataaatgcccaaattaggggcttactcattggaattattcctttctaatttcttctctttcccgctaacagagataggcattcttggaaacaacatgttttgaagactgtggttgattttctcaaattttcaggaacaacaccgctgacccatggtagaaacagtgttctaacagagctggaaggtgctagtaagtccacagtgctgacattctttcatttgcatttctggttaacctgctcctcagaaaagaagtctgtcatataaagtttggtgtaacttcttcagtgattcccctgcaatctgatacagacttgggctcacaccttttttggaggtagggatcttgtctggcgtagtcaacagtacatctcaagagctcattatatttctttacacatagtaagtgctcagtaaaaatttgttcaatacaaacaaataaatttttaaaagagaataccaatattgtttggacaggagaaattctttctagctcatatcacttttcaataattagaaaagatgacttggaaacttttaccaagatagtagcaagcacttctctgtatagaattttagagctgcaagggactttgaaaaatagcctatttaatttacatacaaaagtactgagacacactcattaaaggcagagaccagatcagaagccaggtttttttgctttaaccattctgtctttcctctggaggaaaatcactttgcacatatcatcagctcttaagtttgatctctggcaaagaaataataattgatctaattatttcacatttcagaacaacagttaagtttacaaatgagtaaatttattttgtttataggtttcccctttgaattttaatttctttttaatgagctagaatttcctttgacttctaagattttaagtcaaaactaataattactgatagctgcaaaatatactatgtttagactgctctaagaataaatagctgtcaaatgtgttaagctttcatggcagattagataatattctgaatcatttgaaggtatgtattcattcataacacattaacattcattcattgaaaacattttctgcctaaacaatcttcaaagattttctactctctgaagaataaagtacaaaccccttcttggtattcgtgctctaagacttgcctctagagtacttttaaaattttcctttatttcttcttagcttaccttaaactccaaacaaattgacgtgcttatcgtttcttgtagctacccttagttttctaaccttgttgcttttgttaatccttgtgtccttaatgtggaggtattcattccttactcatttattcataaacgaatacaactagttcaagacctatctcaagtgttggcttcttaagcttttgttttacattcctcccctctgaaatattctctctcttccacatactcctaatattttatctgatgcttcaatgcccctgttccttttgacattgtatcatggtactttaagtaactttttatctgcttataaattccttaaaaaatattctttatctgatttctcttcataatctctgtagcaactttttcattgtgggttttcaataaacctggaaataatatatctattaacaacacaatgcaaaggaaaatgacttttaaaaagagataaactgtcgtatttttattttaggactctataattaatgattgaaaatgccttaaaagacccttatgggaaactgttaaaagtgttttgtttgtttgtttttaaataaaaagttatttagcatgaacatacctagaaaaatgaaatgagttgtataaattcagtgtgtaaatgtaaatgaataaaataatatgtgttagatggggtgactggtaatataccagcagtcctgccataaacaactttaaaactggaaaaacatgtgaagcaaacattttcaggcagcagccaacagcagtgcaagactgtgcacactgacagaagggaatctctccctatgctcccatgattgcccagctttctgacagccaattccctgactatggtgcaaggagccccagtctgaggagagaatgtggtactcagagaaaccgaagagacagagatcagagttgagggcagcttaggcaggatagagtagggcatgaaagacaagggaaattggcaagagaggtgactccaaaagcttatgcacaacaatgccaagagtcatcctcagtggttaggggatgggttgtccacggatagggaaagaccacatggtgcttaccagattaaagtactacaggattaacagtgcaatacaaatactataaaatgagcagtgctggagaagagcaggtctagacatactttggagtatgtcttgacatctacctccttcttacctttggcattctgctatcacaatagtaagaaatccctggcattagctagacaccataaaatcttcacattaggtttgaggaccaatctctctaatttctactataggtctaccctagcaaagcataaaatgaagccccatcaatatctgggcttcatccagatctgtactagcaaagtgaaagttcaagtccaagtaagatcaatatgatcagtcagtaattagcctaccttctaaaacaagaacgaacagttttcagaaaaagatttttaaaatctagaggcttaacaatgtattattcaaaatgtccagtattttcatttaaaaaaatcacaaggcaatcaaagagacagaaaaatttgatccttagtcaagaaaaaagtgattaatggaaaccaaaccttagatggcctacttgttgaacttaaacagggaaagaccttaaagccactaacataaatttatcttaaaagggaaattatagtcttaatgagtgagagaatggggatccctacagaaaaatgaaaactatgaaataagaatcaactgaaaatgctgaaataaaacaaatacagtaacagaaataagaagatttttaagggcttaagaccagatttaagatggaaaaaatagtaagtaaacttgattacaggtaaagagaaattattttattttagtaacagagagaaaaaacaatgaggaaaaacaaaggcttaggaatgtatgggacaatatgacaaattgtcttcctttaaatgaaggaaattcgagaactgctttgttttgtttattttggtatatccctaattccagatgacgggcaactaaaagttattgcttaatacatttttattgaatttaattctcattaattttcagaaaatcaattaccttaaaatatcaaataactgtatttcatatgtgatatgtcttttttcatctctaaattaaaagctcagtttactaaatgaaatatttttatttttaataaagaatgaatctgtgtcctcatcaagtactggcaaatattaatatcttaaagaggttggtatttccagcacctcaagattattgacttttgttcaccctttcctttaatccaagtcctattagaaaatttgttcaaaattggaccatttgacatatggataagaataatcctctgtcagagagatatgttaaacgttgtgactaatttctgtggaaggctatattttatcgtgtatgaatgtcttttataaagtggatatgctaattcttgctcaaaagataattggcgtctataaatgaaatcaggacaaataacataaatttaagtttacatgggaaatttttggtttgggttaggctgaaacataccattataatacagtgcacttggaaactgtcaggcctgggaattgccaaacactcgttggaatcaggagctgcagacagattttgaatccgagcctaagtttactgtcatataaatagaatagtcaattttctgaaaggatatacattctttttaaccctagagtatcacaaagtcacttataattttaagtgttatcttgtactaaacgtctgtttcgaagtttagctcttctgtcttaggaatgaattcttggagctcattatgtgcctgcatgtgatttatcttgaataaaaagtgggctctcattcaattttgattacaaagctgtttgtggctatttggcttcaatctgatttgattgatttactgcttttcatacttactgacaaatatttatagttgtaatttataaataaataaataaaggtactaatttgggggacatgtttagtgataggagctattgcacagaaaaaaaaactaatgaacttttaaaaaaacttccaaatattttactattataacattatcttatatatataattctccatagaattcaaattatttaacagatagtccttagtgaaatctatagtctattgctgacaggttgggaattggcacacaactatggatataaaataacagctgtgaagcaataaattatgatttgattcaggtccttcacttatgaaatgagaactcaggagctcaataacataacatcactgacttccctggcctgaattgctcccacttgctctagtaaacaaatctgttgcatcttttcacccaatcttaacctggaaacctagcttcacaaaccacatatcagaaccagccactggagttgtagggataaatatgtgctctgtaatgatgcatacaagcagaacttcaagtaatacactttatcagaggcaagtgaaaaaaataaagaaggcacatgatgttctgcatatttagaaacatgtaagtatgtatctttttaaccactggtcttactgctctgtagttctttttcagctattgaattgtgactgttattttctaatataaatgtcactgatgcacttcttattcaaggaattactcttttcaaatcttccttttttcgtgtatgggacatttttccaatgtgttcacaatcaagaagcactaaaaatggatttaaaatcttttatcctaactacatttacagtacacatatcctaaatgtgaatgttttcccaaagatttccctttaataacatcagaagagtaatactacaacatcagaatgctaaccttattcatcataaaattactaactttaccttttcttgctttaagttgattagcgttgattaaattaagctctatagtgattgttcgacatagatatgtgtgaattccactggtgattatagcatacttttctgtactactaaaaaaattctatggaacatgtatctttatttcagatgtatgttcttaatttgcagttatagagtataagtgtatcttgagataaacagatgatggagtccatatgtttttgctgtagtaagtccaattctgaaattaagaaagtggtaatcattttattcttgacaaaatataaggtgcagacagctatattttcactttctgctcaatggaatttcccgtgttaaaagatgaaggaagatatgtgcgttttaaaattctctttcaattgatactaatactaaaataaacatgtagtacctacaaatatagaaaggtattgtagcgtacatcagtatgttagatcatctgagtagtgtttatttttattaatggttagtgtttgttagtgattacattttctactaagagtactcatggtgctttgcagtatagaaaatcttactggcactaatctgtaacaaatacaccttcactttcacaagaattttaggtttatttcacaaccctcttgagaacctgtgatatggaaggtgctctgccgggcccgtcatgttgagatctactcatgctcttgagagactgctcctcttattttcttttttaaaaatagttatttattttttaatttttattttacttttaagttccaggatacatgtgcagaatgtgcaggtttgttacataggtatacatgtgtcacggtggttcgctgcacccatcagtccgtcatctaggttttcagtccctcatgcattaggtgttagtcctaatgctctccctccccttgtcccccacccccctgacagccccctgcgtgttatgttcccttccctatgtcctcttttttatgaaatactgaagaattctgggggttcctgtaactgactgggaaatgatgaagtgtttcacagatgtccttattcccaaatagcaacacctctgtacacactactttattatctagccagaggaaaaacaaaataaagcatctcaaagagtctcagaccagtatttataactgccgcctctacattctctatcattccacacacatttttatttacctcaaatacatatcctttttttttttctgtggagtagattaagaaataaggaactaccctcaaacaaaataagttgagggcaaaaggggtctttggtatttcactattgaagatatcaaactatttaaaatgtttcttcaaagtcttgctttagaatacttgcatctactccagatttccagatgaacaagcgcttagaactggttacacatttaatttataaacaatttttgactgtctctgtactctgggttgggtctggacagtaaagtaagaaactatcctctctgaaagggcttactgcttggtcagtggagaggcatgtaagcacagaggcgtgattcaatgttttgtgtgttgtgaggtgcatagagtgcaggcgaggcgatgaggtggaagagggattcacaagggagtgacatttaatctgtgtcttgaaaaacatgttgaagttttctaggaaaaaggaacattcagaggcagaaagaagaacagagacacagaggaattaaataagatgttgagagcaggtggagcgtttttcctggtgattgggttagcaagaaggtgggacagaggatgagacataatcatgaggggcttccagtaacaaagagaatgtaaaggaaggaaatgaaagagtgtgtcttgtagaagtgtatagtggaccttgaacaaactgttttgtatcttcagtaaactttaaactttattcagtcttcagtaaacaaaatatgctttcataattttgaatggaagatcaagattttgaaactttgaacttgtaattagagtagatgcatcagaaactataaggatcacagttgctaaaacatgatgcagtataaatctatcgatacatgcaaccccttgttcaaaggacaaactacaatggttatgaaaagtatacagagaaaagccttctattggtcaataagaaatataggggaattcatgttgctttcataaaagcctatttttaatgatccatctcaaaatcacctggtgagcttgttgaaaatgccaaattcctgaccctccccagagaaattctgattcagttggcctgagggtgagtcgctgggctatccatttctaaacaccccgggagattgctatgtctgtggaagctggagaaccagaccccctatagtaaaaatgtgtttaatataggtttttgtgatcttgaaagcatatttacttcgagcatatttgatggagatagtgtaaatttcctcccggttaattcagcctgtaacaagacatggccataggaggccataaccatgccaagccaccgcctacggggtagcagctgactctaattgaagggcaagttcttgcccatagctgtggttctgaaagcaccgacgtataaagcaatgggaaacatcgtctcaatacaccggctctttgttaacattcaacctacgtattctccacatgaaatattccaatcaggaaacgctggatttgctttcatttgagctagtatcagctcttttcagatgtatcaacagataaaaagttaaataggaaagtggcttaattgctgtggcaccaaagcgtgggcggcattctctctctaaatgttgtctgggtacattgcaatacgcttaggagaggcatgagtattgtccctgttgagtatcatttgcttaggcgtattctttttagttatttcattttgttacactttttgataatgataaataggaaattattggcttcattttaaaacgtggtaggattgcaagtccgatgctgaaatttaaaattctcaaagatggaaagtggggaaataaaatgagtggttttcattcttcccaaattcccactccccttttctgcttcctgttctttgctttctcttctgtctgtgactcggtgactcttgtcttcttctctttccatcattctctgtcttctgttaagccagccaacagcaagacaaatgagactgattctctggcatgtcagttactctgttgcatgatctgattatttttccgttttggtttattatatatggctgaaagcttcatcgtcgtattccaatgactaaagtaaacagtatttatggtttttatgttaagttttatgttatataactacacagtcatcattgatgtttaatgtgtaaggatatgcattgtttaagtgttaaaacatgtacttagaaataatattggcatttgtctttaatggaaaaaactttttttttttacattatggttgccagatttggcaaaccgggaacatgacaagaaactacgttttacacattcttcatctcagttactgaggagacggaacaattttctctctggggattctttagaaataaatcccaacaaatttccatctattaaactgcatgttttaaagacaaaaatggatggcagtttgggttttttttttttttttgtacctttatgattattctaataggattagaaacagatcagaagtccttgagcttcgtaacgaaaaagaacacactagatggtgctgtgatcctagcagcaaaaccacgcatttaaacagtgcttatgtcaaagctggaatgaaggaaagcccagtgtgcatatggaattttgtctgacactaggggatacactaatatcagtgtacaattcatttttgcagcatttatatttacctgaaaaaatgacttgctgaagttctgcgctatgacaacattgttttaataaatgtgtgtgccagtgagaacatgaatgcttacgtatgtttatatgggataggtattctggttttatctgatttgtttctgatttttatctcccattatttccttacaggtgcactatgttccaatgcgactggaataatcctagacacagcttccatcttcacaccatcttgtctcccaccctttgttcctccaagtgagatagatccaccatctgtttctgtccagaccttgcctagcctatcagaccaatttcgaatgtcatgcctttcatgaaacctttctgattacctcaatcattccttgtttactttttttttttttttttttttttttgagatggagtcttgctctgtcgcccaggctggagtgcagtggcacgatctcggctcactgcaaccttcgcctcctaggttcaaatgattctcctgcttcagcctcccgagtagctgggcctacaggtgcatgccaccatgccagactaattttatgtatttttagtagagacggggtttcaccatgttagccaggatggtctcgatctcctgacctcgtgatccgcccgccttggcctctcaaagtgttgggattacaggcgtgagctactgcgcccgacctccttctttactcttaattctcataacaactctttgtatttatcttatgcatattatattctgccttgcactgttgtatacttttcttactatactgtaagcaccttgagaacacagataaattcatatgcatattttctctttttccttcctctagaaacctttataagaagtactgcatcttgaatgtaattggtgctcaacaatatgcatacaaggcaggagtaaaagaatgaaaaaataaattcctgttagaaaagcttttgttctggatatcactgtttgccctccaagttccatcacattgctccgaaccatgagaagcagacctctgtggaatccatcaaccagccatgccccttggcctccagctggtgtggccaatgggaagcaccacaagaaatatgaagataagaaaaaaagtgtagaggtatttatttttccttctccatctgagccaagtcatgagttggcccaactgtattcttccccagaaggccacaggtatctggtatctggctccgtttctttgctccttcaagccatgggtgataactttggatgtttcactgtctgttttccttaactctgtcctgttattaaactctctgaaataaccccttttgaatatgccatctatgactcatacacaactgatgacccataaaggacattggaaatgaattgcttcacataagaggtcattctgataatgcaaacaggacacagcatcttagaggactgtttatataattgtgatttgattttacctttattctcaggtcagaagacagcctactgtgacacgtaagtgtctactctgatttgcatagaagtttaaaataagcatcttaatgatttgagaacattcactaattgctaacactattaatatatttccttgttttatagcccaagagccatttatatattatctcatcttaaaacattccatcagttatttttctgcttacacatagaatttctaaatcaaagatctgaaacaccaattttcacaccattctccaagggacctagattcctaatgtaagttttaacttcaacatgaaaaataaaatatatttgtcttttttagtttctagcaagtctgtgatcaagatggacatcaatgtattagaaattatcataaaatgacaatattaaacacctcgttattggataagattgagatgaaaattccttccttccttcctttctttttttttttttttttttttttgacagagtcttactctgtcatccaggctagagtgcagtggggcgatctcagttcactgcaacctccgcctcccaggttcaagcaattctcatgccacagcctatagagcagctggaattacaggcacgtgccaccacgccagaaaaatttttgtgtttttagtagagacggggtttcaccatgttgcccaggttggtctcaaactcctggcctcaagggatccactcgccttggcttcccaaagtgctgggattacaggcatgagccactgtgcccggccccagatgaaaatattttatgttcatcaaaaaatatatagtaattgagaaatctgttcactgattctctttcaaaacagacaatagccacgtgaactctctgagcctcactttttcagctataaaatagtagtaatttatctaacacacagaggtttcgtgattattaaatggcatagcatatacaatgcctcctgctgagagttgtcaaaaaagtgctccatacataccagttttcttcttttcctcagtcacatagtcacttattggatagatgcatctatagcccaggtttcctgacttcatattcaggtctaattctgctttactggagctcccctagttagcattcatgtccactaacctcttttttagttataattttctttttttgcagattgtggaatataacgtatcaggaaaatacagactgcaatatggattttactcactattagaattccaacatttattttggtgtccatacgcatatgcagtcattattttagacatttgttgatttcccttctgatatttacaaattatgaaataagaaagccatgacctatgtaataacagcatttgatctttcattcataatttactaggctgtgtgtttttttgagattgctaattaaatgacccatttgactgtatttatatttctggcttaatcaaaaaggacattcagattcttggttgtcaataacctgcctcttgacttctttaaattgtcttccaagtactattgctgaaattgcagggctcatacccacccccagatgtctcaactgttcattcagaacacaaagccttagccttgtgtttgtcttatgcgaagtccaaataggatcatttattctagttcctgtaactcgttcatagattgcttttctttgtaagagttcctgttctgatgactaatctttatattacttcccttagcatggacttctggggattaggacccaatcccacatttaaccatcgtagtcaggatctcacaccttacagctgtttctctaaagtctagacacaaccacctggatctccactgcttacttaataagagttttacctcttacctgcttcccttgtatgggaggaaaagtaatattttaactcactcattgtaagacttatggttgatacccctgaaacaaagacagattaacaagagaaaagtataacaaatttatttaagttttatatgacatgggaaactttagaaatgaagactcaatgacaaagcaaaagctgtatatttttatgcttagttttgataaagaataagtagttggaccaaagggagtatgagctaatggtaataaactagggggaacttagcaaggccagtttcttccaattcttcttggcttcagaatatagggcaggacctctttggagtcagcatcctatgatttacttccaggggagataggtcatataattatttttatggtgttaggtgagaaaggtgggagaaggtcaggaaaaagaaagaaaaggtcagagagccctttctgcttttgcacgtttgttaatttcctccagcttaacatactgaatatgtcaaagtgtcatattttggagtaatgtttcctgctcatcatcaccatggtcttcccacttttcagatgctttgcagacattgctgaccaacttctaacattggttccccgaattctggaaggacggcatgcagcctaggtgtctgtgtctctcacagtcacagatttgtcagctttcaagatcccaattcatgcgaatctaacccattccttggctgactaagtcatgggtttgacactggggagataaagcaattctgggggggagatgagtttctgaatttgttttaaatgtaggatttgtatcaaattgtattgctgattaaaggaaatttatagttcttgttcacatattcagtctacttggtttgaaactattttgatgttttcactcttcagatattaaggaaaggacagactagctacacagagttaacggataaaggtaaaaacacaccataaaatctgcagagcaagaaaacacctaaacttcagtccctgaaaaacagaatatagttcttaattttctttaaaacttttcaaagtttctcctgaagtctgcctatagccaggcatcaaatacacacttacacttatatatacaaatgtacatccatttatgtttgtgctaataaaggtatgttttacatatgcgaatatatgtggagacagacaggaaaataaataggcagatgatagatattctctcactcacacatgttaattttcagataattccctctagaccagggattttcatggagcaaagcatttgtcctgctgatggggctgccttggtctacactgacatatgcgatgagcaaaggacagtggcttttttaatgtagaagccacaagagaatatgtcatctgatgtgcaaattacctctccagaagtatgattacttacaggcgagtcctaaaacacatgccctctgccgatagcacaccaaatacagccaaccacggtgcaactttggacacagaaggccttgcaatgttgtaagtccctgtttcctactcaggcccagtagtcactcacatgagagagagattaaaaaaatgtcctaaatcatcttctgcctttatcaaaccatggtctgtggagaagaactaggagaaccctactccacacagagaaaatgaatgccatattatcggacaccaggaaaaagggcaggaattgagataaagatgatgttattgccacatacagtacaaatgtaattattctgtatggaggaaggatcactgtacatatgaagaaaaatcatgtatcagagtttttgtctgttttctgaaaagagagtgttttttcttgagaaatgaatccttctgtaatttgacagatatttatagttgtctaagactatgcaaagtgacacttaaaatagtaactgcaaacatttttgagaatttactgtgtgctcaatattttatatcttaaaactgaaaaccaccttatgtcatactcttattttctccgtttgactgaggaagccttgggggagtaggatgcaatcaggtcaaacatattattagtagtggacaaagagtataaacagctttctagtaactgcacaatcctagaataaaagaaggaggatattgtcagtaatgcatacacttcccattatagctgtagatataaatgagatggaataattcttgaagaaattataggtacttatcaaaaggatttttcatacctactggtgacaaagataagataggaaggaaccaggtaagcatgactaattttgatttttgtcaattaacttgttttgttcttattgaaaacacaaagatcttgactctagcctacagagggcaacgtaagctccaagccagcacttgctaagatctttcttatctggttttgcacacttggggaataagatctggactctgataatcattgttatttgagtgaccgtatcatttgcactcagaagacccaaatgcagatcctagagatatgtgaaacaaaactcaatgctatttaaatatcaaaataaaagttgagggacaaccagggaggatgaatacaaattctaaatagaatcaataagtaaattagttgagtctaatctggctgtaaagtcatttatatgagaggattacagattcaaattatgctagaaaatagggtattatgtgttaccagactccaaagacaaagtcttcaagagcacccatttagaaggcatgagtccttgcttggcattgcagctgactaaaaggctcaactcattatttaagatccaagaaaaactatcctggtgtatgcactttcaaatattattgatccagaaaaacaaacaaacaaaccaaaaaaaacctctctataagaatgaaacctcatttactgagaaattaatcccaattttcttaggataattaccccaaattatcttggaaaggtagagctacttcattagcggtactgcagatgcacctggtgaacaaaatatacattttctcttttttttcataattggacctgctgagattgagtggagcacatgtctatccatctagagaggacacttgtcagactcccctatagttgtagccatatgactacattgtaaacagaagtttgttacaccctctcctagtctttccattaagataatttgagtgtgtactaccctggctttttctcccttcctgctgggtgggagattgtgtatatggaagtaacgactttggacttgaaaatataagcgacattttggaaatggaaaaatccatctagtcaatccagagtaggtgaagaaacattctactactcacccacctcttaactctttctttctttctttctttcttttttttttttttttttttgagacagagtctcactctgttgcccagcctggagtgcagtggcacaatctcagctcactgcaacctctgcctcccgggttctagtgattctcctgcctcagcctctcaagtagctgggattatagacacatgccaccacatccagctaatttttgtatttttagtagagacggggtttcaccatgttggccaggatggtctcaaactcctgagctctggtgatccacctgcctcggcctgccaaagtgctgggttacaagcgtgagccaccatgcctggcctaaactcctacatgagaaagaaataaaattataacttgttcaagcatatgaatattttaacagctttattgagatataatttacatgccacctcttttaactgaaccattcaatggcttttagtatattggcaaggttgtgccataatttaatttagaaacacttgaatcactcccctcagaaaccttgcatccattggtagttactacctaacccccaagccctcattcagcagcgcttctccagttctgcaaaaccactaacctactttctatctctatagatttgcctattctggatatttatataaattgtataatatgtggcctttgtgattggcttccttcatgcagcatgtttttcaggttcatccatttcgtagcatgtatcataactttatcacattttactgccaaataatattccactgtatagacatgccacattttgttcattcgttcatcagttgatagatatttgggttacttccagtttggggctattacgaaccatgaacattagtatacaagcttttgcatggatgtgtgtcttcgtttttcttggctacatacctaggtgtgaaattgcagtgccacatggtaactatgtttaacatgttgagaaattgcccaactgttttccaaagtagctgcagcatttcacatttccacgaatagtgtacatatagcaaacgtgtttgcaactccttttattgctggaactgagcctctaccagagtgatatgcaaaacctgtaacaatgggtacatatgggatcaagcaatggtattcggaagtctgcttaaactggctcatgagaatgagttgttaaatgctggcatatgctacaaatcagggcattttgttccggagagctggtttaccacacccccactggaaccaaccaatcggaatgaatgctaagatagtgagactagaaaccagctgtgaacaacaatttctcctactctagagaattccagttgaatatcaattttatctattgtgtaattaatatgttggccatatagtttaactccagtcagatataagtatagaaataataaaataattcaaagtttgtttttgttgtttggaaattatcttaattatgtaatatttcagtatttgtaataaatttggcattttagagagtataagagatttgacttatgttcaaatttataatataattgaaaattaattgtctgggtgcagtggctcacgcctgtaatcccagcacttcgggaggccgaggcgggtggatcatgaggtcaggagattgagaccatcctggctaacacagtgaaaccccgtctctactaaaaatacaaaaaaaaaaaaaaaaatttagccgggtgaggtggcggcgggcgcctgtggtcccagctactctggaggctgatgcaggagaatggcgtgaacccgggaggtggagcttgcagtgagccaggatcacatcactgcactccagcctgggtgacagagagacaccccgtctcaaaaaaaaaaaaaagaaaattaatttagattcatgattttaagttaaaaagtatgaggaaatagtactgatagtaaactgtgttaggagttcagaaaaacttgtgagtcactgtatttgtaaatcaaaagtattatagacttataaggatggttaagtacttaggttttggttgtaagaatcatttgaagtatttcaaagaaatcaaatacagtaaattgatatatgcaatttactaaatttagcatgtttactaaaagcgtctctctcgatgcttgccaaaatttaccagattgctgaatagaaaaaaaatgatgtattagttgaattttaaaaatttaggaaagtttagattttttacatttgattttaataaaccaaatattaattttagaaatcaaattaaactaaaatgtattttatttggtaaagatgctctcaaggacataaagggaactccctggttcacaggatctatctgaacaggtattttcaggttcctgactcaaagggttcaaacatgggcttatggaaaaatatttgaagaaacattgagaatatctgtacaccctagaaaaagaaccaaatggatacactgattgattgtgatagaaggttccatttgcattttgtccccctgggaacttgtgttagcacttgtccccatgactgagagaacagccctgttcagggctagcatcttctcgcatgtcccactggctcttctctgtgttccacaactgacatgctagcctgctagcacccagagtccttagaactatttgcagattttccatctctgttgatgcggttgttcaacgttaacttcaaatattaaatctgtcttaaataactttttatacaaatttaaagtgccctggagagtactgggtgccagatcaggaatgttatcatgggaatggctgtagtccaaggactctgcctccgtgaacttcattcttagctctatttgaattgcctgtctcactgaagcaaagaggaaggttacagtctgcattttctcataggaagagttccccgtggctcaaagtgcaatttgtcaagaataaatcctactgtattaagataccttctcttttacacaatttaaagtgcctcctgttagcaatatggttccggggactccctgacatatttttacatttttttcctgcatttttgctcatgatagtgcggcttaccattatttctaaagctgaaccttgatgtcctatgaatcacaagaacaatgcttgattatgtattttgattctgcacattgcttatgtttccaagtcttaaaggtgcaattgttttttgttatttgtttattttacagacacaagcaagttccagtcacatgtccatagtaggacatctgcaagaaacattactatctattctttaatctatctaaattttgttgtatatcacatttacattcctctaggaggaaaaatgcttgagtcgatatcctacgacaattataaaaactccttgagagattttcagaatctgctatgtattaatagttcatgtccaaaaaaaagagaaactagatccaaattcaccatcaagatctctgctaaaatcttctaataaacccgaaagtagaaagacacatcatggattccaaatgccttattgagtgcctgagattctggcatctatttcccagataactgaatgtctattaatattgagcaagtctaaaccatgaaacgactgcatagttttgattataaaacacctaatcaaaccattgatgggaatacttgtatgtgtttgtttggcaagtatgtttatcactcagtatcgcattgcaatacaagaccacctaggtatcactgaagccacccttgtcatgtgcttcttggcctggcaggacacctgcagaagactgattgacagcaggttatcctgaagctctgctctgtaatgagaagtgagatagtcagaagccagatgtgaagaaaaaagtgctttcaagtttccttaaaaggcagcctcaaaaacacttaatatggataagtaactaagaaagaacagtagcaagtaacaatcaacctggaaaaaaggtgtcagggacagatgacttttcatgagcatcttcagagcatgaatctaaaagacagagatgcaaacagtgttaggttgttgaaaaatattctgaaaatgcttacagtccaaggaaaatgcttcgtaggtgatggaagacatcatcatcttttctactgaaaccatatacatatataggtgacatacttgaataggattcattgctagatattaagggtcttaataattgtgtttgggaagttgaagaaaagcaaattatgaaactgttaaatcaagtttacaaaataaattccacttagaactgtgactttagcttacatcctgaactcttaggttttgtttgttttttgtttggttggtttttaagtataaaactttcctttcctgtggagacacatagctttaccctcctttgcctttcttcagaaggcccgttagatctaaaacctgttctcttaattctatagacttatgtcctatatgaattgataataatgaaaaacattacaagtaaattaaatactagaacaaaattccaaatgatccaatattctatatattttatgattctgtgaatctgtcatgatggattaaggacattatcacctttaatttgcacataatgacattttgatatcataaagttaagagtttttagaaaaccagaagtgcttactgctaagatattgacaaatgaatacgtgcagagattggctttttaaagcttgcatatgttagccttctgagagctctaccctgtctcaattcatcacagatcaagcccatgtggtaggttaaggatatagatttctaacaaactatatctcactcccttgtatctcactgcctcatgcttgctttctctttctccccaccatcctcccccacactctcttactatcttttgcttaagtctgaaccataacattattgcaatgatgtagtttgcttgtaccaataactttcttgtcaggagacatctgttttgttatgaaaagtctctcctagtaaagcatcaatcatgtcacgcttgtaaagcaaaacacattttttttttgtccctagatagcaaaatactgctgagaaaacaaactgtgcagaaatattaactggcatattaatacatgtattctgaacattctttatttgtctactattggtgccatgtgattctgacagtctctgctgctgacctctcatctctgaaaccacagaggactcatcaatgtcctccttaaaaggattgtaatgggctgatagccacagagatccacatgatgggaatatgctgtattttaggcaatttgctttcatatgctaaaagcacaacgttaaaaatggttgcaactgtctgagtgcctttcaaagctttggctacataatgtcaagctacctggaaagttttagacagtcatctaggtgttttcgaatgcttggttgctttgcatcattggtatgaaacctctggatgatggacttaaacctccacttgacgtcttgatgttttagattttactgacatgctcactatgtgcatttataaaaccggattctctgctttgaagcccggatgactgctttctgaagttcaatcaacctcaggtattatagcaggggttgaatgaattgagaatgtattactctttgtctaagtcaaggcttgaagtggagtaaaatataaattaagtagtttgggtaaatacttctgtaccaaaaagcaaccttgaacattgttagagctaaaagtagtggatcagtcaacaaccagtcaggaaaacaaaatcatgctaagcattttaggtagaaggaaattggatacaaaggacctacaaggactagaggaactgaaggaaaaagagaaaggggtatcaagggaccaaaaaaggaaggagtgatgggtggagattaagactcttgcgctatccccctgagccaagctccctggaaccagcttcttcagcgttctctggaaattctgacaattctagagcaatcagcacctaagtgagtggctactgcttccaggggctgtggagccttcaggcagcccctccctgctgctcttgtagcaacaaccaacaactgtcagcaatggccattgggatctgaaccacaaggaagaaatgcctcagtttctcccactttctgatctcctggtagcactttcaaatgacagaactgaatgagaagccaacagggaagggagtgtggaaatgtagcttgcagactagcagccccagaaactctaagcagaacagagaggggcaggcatggaactagaggcaccaggtaaataagcaacatagacacccaggtagaagcaatgatgttttccccattaacatttgacacacataaaatcaggatataattgacatcaaaaacgagatacagatgttgggcgcaaagggaggtacaagaaagggagaattgtcacaaaagcacagcaagtgatctgtggagtgtattaaagtagaaatggcatttgcctttgtagcctgttggcctttctttttatataaactaagacatgggagattttctaaaattattactttcaagtttttcaaataatacatgaatataccctccttgtaaggcattaaaatttatggatgtaggttaatcccctttgattaccaagccaatcctagttcctttcccagaaattactactgtcagtttgatgtatatccaaagagggtgaaatatccaacagtaggaaaaatgaccaagtacattgtagcatatttacaggatggagtatgtgtttgcttttcaagagaataaagtagatatgcaaaggtttcataaatagcaagtgaaaacttgaatttgcaggatatatcgtatgtgttccattaatgagttttctaatcgcgtacaagataaagtcttattttctctctagcacgtggctgtaattttattttctgtgtccattgctccacagtggatatctgggtcatctctcagatggactcagacttgaataccttccttctgtatcattgcacattctctgctgtatttcccaccactcaattgaccagaaagaagaatgttaggaattagaaaaagagacaacaaaaaatatatatatataaacaaagtagaattataggtaacatattggcattatttgtggttgcaaaaacttaatcattagaaatggtctttcacaaatgccgtggattctcagattctgtcaagcagtttaaaaatcggctctgatttctttctctctttcttttctttctttctttctttctttctttctttctttctttctttctttctttctttctttttttcctttcttcctttctcaatgcttagatacagctccttgtacataatgaagttgccatttaagggagaagctttgaaaaagatactgattaatatgtaggtgaaatctttgttagactcctaaaattacatctaaaggaagaatcacaaaaagaaatgcaaaaaaattcagttgcattgaacatcattaaaaaactcacacattgagggacaattcacattgtcttatggtctcccccagagcagacctgagataaagcttgcaggcagggagtttatattgaacatattcccagggagtagaagtcagggaccaagggagtgaaattagggaggcaatatcaaaacaaggtatgctatgcaactgatcacctatgtctgcatatgacagatgctagatttcaccatgaccttctgagaacctttgtggaatgcatctcggaactgtccatctgaaggaagaaagagaaaagcacttttctacccatttctttccttcacttttcaaggattgtcccacaaagtggtagctcttctataattttgtgttgtgcttcatgaacgctaatggttcatgaaggtttcccttgccacccggtcagaaaaattactggaaaggacaccagagttaacagcaaatgcctgggatgaggcagtgccaggttacacctgtgcaaagccagcccacatagaactcgtcactgcatccagagctgaatgtgaggccaagggaacttggagcaggacacaagaggtgtcagatccacaattcttaaaaaatatcaaaagcttagcacctgagtcacatatgggttagtgaaggtgaatgctgtattaatttgagtatgtattttatctgcctgaagggattataaatagccatatattcttaaatgtcccacaagtttaaaatatatttgaatatataaaatgtgctctttgagagcaggagccatattttatctattttaccatcatatgtgtagtagagggacaggcaacaaaaggagctcaataaatatttagtaaaggtgtacaggagaacgatcttcaaagacagctaatgtaaatccagtctgcttggtcttttcaatgtcagacatgtttaggagattaaaccctttctctcttcactatttactttcctttttcttcggataattgtgaaggcagaaagaagcaatgggtgctagaatgggccaggtaggatattacggtagaatgagagagaattaaatactttgccaaaatatgctagatactttgtaaattatgtgtcccagcccccatgtatggggttaactcacatgcaggacttgtttctctcccctagttttcctgtctcttatcctcaaagtcagcctataagcacacagtcttttgttattttcatgtctgccatgttcagctcatattttaaattatggcataaaatcgttgttggtttcagaagtggtatgagcagagatataagttatggagtaatatctggagcctgcagtgggccaccctgaatttgttgttaccctgtcactgtcttctcaacaaatgggccagatttcagaaaacgtaattacttaaatggaaaccatgaaatgcaattctaaatcagttgataatgtgtctctgcttgtaggcagagtcccatctaagaaggatgctggcttctcctgctgttggtctgtttacaccaaactgacttgatatttttatctgtttacgaagtggtgcaaaatgtttacatagtagtgacctggtttctgtggatctgggagtgctgtttgcagtagaatgtttgctaatcttccgtgacgctctaatcgtttgtatttagtgaggcctcagttttggttgatagagctatttagaaaatggctccacttcaataccaaccttgttttcttttgtcttcggaagagtggttttagaagagctccccatgtaccagactgttggtcttttactttagatttgattcaagttaaacactttggattcctgaaaatgtgtatttttaaccatttaagatattgaaattccaacagcaaaacatagacaaatacaacctctgattagctgcagatttctcagaactctagtttccactaaagtgtatcaacctcatcttcagtctaagctgttgctgggctattcctggacctgtctctggaaagcaaaactgagtttttctacatttttaacaaggtattatctcccaggcgcagggaacttttcacttaggactaggttgcaaatctcggtgatgaaggaggtaaggacggcccaattcaccttacaattctgatgtgactgtcaactgtgacaatgaataagagcactttacaagccacattgaactgaatatgtaacaggttagtattgatgtacattttatttgattccaatcctgaacactattcctagacttaagtccattagcaggaaatggagaagcactgaaatggaaatcacgagccttatgtctgcaacccctctaagtattcaggtaatatttgataagtcacttgtcatctctgggcctcaaagtcctcactggcaaaattaagcaactgggttaagtaatctcaacatcttttttttagcactatgattctttgtaactatagtacacattttttatgaaataggaaaagctcatgtcatactgtctaattatgaaataagatctttcacctttttatttgttttattttcagataattgttttgaagaaagatcttttataattttacttttatttgcatcctaattcttatatcaaaatagtaatataattttggttctataatatattaataattttacagaaaagtgatgttaggttttttagtaatggacagtttccacttaaaaattttttggtgaaactatttggaataaatatgaaattgatttggggttccacaattgaatatccatccctgcagcatcactcccagcctcatccccgacctgagccagtagagtgagggaggcctaaagttttaatgcttttaaaactacgcttctgaccagtgtttcctaaagtttgttttacagaacactagcatcatgagatgttatagggaaggcatgaaaaaggttccatgattaaatgagtttgtgggttggtagatacagcaaatgtaaatggacttccttactatgatgttttctcacagtttttaatccacttttaatagagcattctccagcttgagtagagagatatgacatgtatgttgtacagtcatgatggaccataggactcttttatgtgagaaaatctcaagggaccaggttccttgggacacactttgagaaatttagtttttattgttaaggaattaaaattaactgagaaagtaaatattcactgagactctaaagtgaggaaacctcgcagctagtgttattcactcatgtgtgctactggaatggtacaattgcatcaggttcagtcatattaaggattagttagtagttttatatttgtttgagagcatattttaccaattaaattaattggctttgtatggtactcagtatactatcaagaacatagagatgtttcacaaatgctttggatgctggagttaaaggtttttagaccttttttttgtagccaattagtaaagaatttatggctgcctcattctttacctcttttcttttctcctttctttaacaaacattcactgagtgccaagtcccaagcgtttttctaggctctggtgctatatcattgaccactaagacagagatccttcctaaacaagtcatgattaagtaggggaagtaaatatgtatttttaaattgcaatacaatggggcaaatgtaaccttgaacacaaatacaaagcaaaaaggcaatgaggatgaaagagagcaactaatcttcaaagagtgccaaggaatgttttcttgacagacacctatctgagtcttgaaagcagaatagaagtttgctagacagaacatgctggttgattctggcactaagattaaaaatgtcaaagctgaggagatagggaacattttgttgagtgtgggaaagtctaagcagttccatattattggaacataaagtggaaggagcaaaggagaaagatataaggcttaagagcttggcaagtgtcactttattaaagctttatgtgctttgtaaaacaactcagaatctggctcaggcaataaagaattctgaaaggattttaaaaagaggagagctgtgataaaacctggtcttaaaagttgacctttgaagcagtgtagagaggctagtgatagggacatcaattagtaagtattgtaacagtccaagtgagacatgatgggtaactaagtcatggcacttatggtgacatatttggatgggagaagtcatatttgaaataagatggtcctcaacttctgatgctttgattataattttttgactttatgatggtgtaaaagccacacacattcagtagaaaccatacttcacgtacccatgtgatatggtttacgtctgtgtccccacccaaatctcatgttaaaatataatccccaatgctggaggtggggcctggtgggaggtgactggatagagggggcagggttctcatgaatggtttagcaccatccccccttggtactgtatagtgagtgagttttcatgagctctggttgtttaaaagtgtacagtacctcccacctctctctcttcctcctgctctgactatgtaacacgtgcctctttccattcaccttctgccatgattgtaagttttctgaggcctccgtggaagcagaagccactatactccttgtacaacctgcagaaccatgagccaattaaacctcttttctttataaattacccagtctcaggtattctttatatctgtgtgagaatggactaatgcaccgtacaaccattctgatttgactttcagtacagtattcaataaagtacgtgaggtattcaacactttattataaaacaggctttgcgttgatgatttttgctcaactataggacaattgaagtgttctgagcatgcctaaggtgggttgggctgagatatgacattcagtagttgaggtatattaagtgcattttaaacttagaatattttcaagttaggttggatttattgggacatgaccccgtcataagtcaaaaagcatttgtatagatgatgcagatttaataatacttgttatagcaacggaatggaatggatgactcccagctgtgtggcttctggtttataagattggttggataatggtgtttatgacgagataggaaatacaagagaatgaatgtcattttgaagtgtaaatatgtttgtttcttgtatataaaattttaagtgccttggagatatacaggatgaggccctaacacaggtgatccattatattcaccttgacttccatagaactattttgtttaatgttatatatttacaaatcatcagcttttaggtggtggataccataagcttgacatagaggatatagtatagtcttagaagactccaagagacagaataataaggaatatcattgtattaaaataaagatatgggatcctaaaaaggagaatgaaaaagttatcattccaagatctaataaatcaaggtgtggaagacagagaatgagagaattttaaggagacatttgttaaagaaagaaaaaagccaaacgccacagagaagtattctgagataagactgagtcttgttttaggatttggcaacgtcgaattctcggtgacccttcttagggtggtttcagtggcagagcctgggctgaaaccacattgccttatatagttgagataaaagcaagtgagaacaatgggttttgctcttttttctcaagaagctttggctgggaaaagaaggaagggaaaggtaagaatagctaaagggggatgaagggtcaagaaaagggtttttaaaatataatcggtgtgtatggggaagagagaaggaaggcaggcacatgtttataagctaacaggtctctcagccttgatactgctgacatttggaaccaggtaatacgtcatgataatgagcatgggatgcagggagtgtcttctccattgtaggtgtttttcaggatgcatgtcctctacccactggactcagtagcaccccagtcgcaacaatcaaaaatatctgcagacattgccaaacatctcctgagggagggaggcacgttgttcctggttgagaaacactagacaagaagaaaatggaagagattgaagatataagacagagaagggaaaaataatgcagaatccactgaagtagtcagaggcacggggatccaaatcacagataaagttgcttcctttgtacagaacagacatatcttcctctgactccaaaattagagagaaaaagagcacagaaatgctaggacattcacactgtggtctggaagattggtcaagaaacgaagaaataactttttttccctctgaattaatgagatgaggtcatctggtaaaaatgaacaagcagcagcagctcagtgagaagactaaggaagtcgaaattttgcaggatgatacagcttagtgaatgtgagagggaaagaccaacaatgagaaacgtcttgaagaatataactgaagccccatattgggaaagcatgactctcaaaacatcccaatgcgatatgtgtatgatttcctcctagccacacccaggcccttagctaaagaaatgcagagggctgtgtatatggttgctgcagtgtggggtggctgtaggaagcatggcactataaatgccgcactattccctatcaacggtagggaaagtgacacgagacaatagctagaatcacagattgataaagacagggtgatcacaggtaccttcagagatcagtggatctcaggcaatatctagctcagtggttttcaagctagtcaatcaatgaaatctcttttaaaaatagatcatagtgcttcaattctaatttccaaaggtgatgtctaaaaatttcagtgagattgagtatattttgtattttaaaatcattcgtatattattttctatatactgtatcttcatatttaaccacttaaaaataagatacttaacttttactgatttatcagatctcttcatatgttaaagaaattaaccctacatgataagtttagcaaatgtttatcccaattttttctttattttgtcttcaagtttatctgtgattttattcaggaattttaaaattaatatattaaatatatcaatctgtcctatgaaatcatagtagttttgtgacttagaaagggtttcttcatagagatgtgataaaatccttctcttatgttttcctctagaattttatggttttgcttttttatgtatttacatttgtggcccatctgggaatttattttggcataggaagtaagctgggggtgcaatttaactttttcagagggtaccaattacctaaatataatttatcagataccctcttttcccccactgttaggcaatgctacttatttcatcaaataaacacatgcagctatttgggtctgtttatgcatcctccatttattccattgatctgtttgtttatttattaatgtgcatatattgaatagctctctgagtaatacccatgatgataaagaaccattgatcagacgaaactcctcattttatgctgaggcccagagtatttaagtggttgatcagagagtcatttagttaaagtggtggagctcaccagaacctgagacccgtgtttctgtgtaagtatgagttacactaatgcctcactagcttccaatggacccagtttttctgatacagagtcattgactacacctgataagcacccatcatttcaagcccacgtacctttggttattctgttgactaggagagggagtaccactgatgattgatgggaagagaaagtgtgtgtagacaatgactgctcagtgatcacgaaagtgccttattcttctgcaggttgaggaatgtgaaccatttgggtgattgtggaaataccgtgttcagattgtgtggttctggaatgggagtttagagataagatgtagtgaaagaaaaacatatggatattgtgtccaaagatggatagacagatatttaacataaaccatgaactaattttcaatggtttatgtaaatgtgtttctctacaaaaattatacattctttttagttgatagaaatctttatcctttgttgtagcatgaagactaaaacaaaataagccgtatttgtgcagtgtttatttcaaagttataatatcaatttaactttgcattttcacaagcctagaatgcagtattatttaacagatagatattacattagagttctttggaattatttttaaagtttagaaaataagcaaaccacataattttccaaaagaaaaagaaacgaattacttcgtcatttcaaagcttatagacagagtgccgtagtggtccttgaagacatgagatgccagttacaagccaattgtatcaaagtatgagatgaataagaaatgattcaaatccaataaaatactaaacaaggacattggttgctttccagccaacatgttagaatacatggggtagtagaaagatcgcctgcatagaatttgctcttgccagatagcaaatattgctagtaatgtttaaattaagtatcgattggataatcttcacaggtggcatattcagattttattcagtctgtgtcttctttactcttcttatgtaatataaaacaactaagataaaaaacaatgagcatagactctaccaatagatttgtggcaaatattgactggtttgaaactttagccaacttaacaatttaatgtcttctgatttgctaattgctttagtatttccaaaataagtgtcaagaagacaactgcaggagtggtatgacccacattcacctatgagacccttattttaactctgtaatagtcttaggatttgaattaaatcctaggcaacactataaaagctagagattccctgtgggtcaaagttatcaaagaagcattacattttaaatttagatgcatcctttttttgggaaaaaaaggaaactttgggaaacccagtgattacaagtttccagactggagctttgagcttaagcagaattgaagaaacactagtatcaatgcattgttgaagcctgaagaagttgagtcataattgaactaggatgtaacttatgataaatattatccagtatgataaaacaatgaaaagattggatttttttccctttcttggagaacacttgtcaaaaattaacttttacccagttaaaatccagtgtggtgatactggtgttgtgtggatgcagccaacaggtgagtttcagagtgacattaggcatatttgtaaaattgtgaacagtctctgaatgagaaagggaacacctactgacagtcttaacttatcatctggtagtgatgtggtcaatgtggggaatgtgccagaaacttttccattcaatctcctggagtttatgccactgtagataaaaccactggccatacataatgacaaggtctacagcagaagttctttggatcaaagcgcattctcctaatttccttctcataggatattctctaccctcaagtcaccccacctatatcaatgaccccaacccctcccacattctctgcttttctatactaaaacatgttctctggaaggattcaagaccagccatttataaattaatatgaaattaataagccatattttccaggttagtttcatttaaagtctttttgaaatcacagattgaaagtgtatattatctcttaaaaatttttagtactcatatgacacagatattctatgattaattttaggtggagtttaggaattttgaatagtatcttgaaatactatgagtgtgtgtctgtgattttatttttcaggtgtaaacattaaatataattattgtatttgctttaatgtattataccattcatttgtatgtatatttcctccaagaaagattccatgtggaggcaaataagagatattgttaacatactttctttagacaagaaggctgaagtccacatcaagataaacttaagtctagaatccagggttcccaatggagttcattcttcattttgcataagaattgttagactaaaagttctaaggaaagtactctgtgtaacttctaataagaattgttttcttccctgaaataatgtccagtcaataaattaaggtgtagagctgtggcaaatattgctataaaaatttactgtgttgaaatctttagaatgcttccttcactttctcacatacccacagtgtttcagagctagccacagaacgatgcatgttgcaatgctatgctggaaatacagactcatgttgaaatcgttgccaacaactttaaaaaaagatagcaagatgtggagaaatcatgaattatgggggaggtcaaggccaaggctgtagaataatttcagattgggtatgcaagtgagtagaggaaaaaagggacaaaattaagtccatttaggtggagaaaatggtattagccaagctactgggacactgaaaaacacagaataatcagagctgggtgagactggagaccaatagggtagaggaagtgggaaagttggtaagatattgtattagtccattctcatgctgctatgaagaattccccaagactgggtaatttataaagaaaagaggtttaattgactcagctccgcatggctggggagggctcaggaaacttacaatcatggcagaaggcacctcttcacagggcaccaggagagagattgagtgccagcaggggaaatgccagatgcttataaacccatcagatctcatgagaacttactgtcacgagaacagcatgggggaaaccacccccatgattcaattacttcccaccgcatccctcacacaaaaggtggagattatgggattacaattcaagataaggcttgggtagggacacaaagccaaaccatatcagatacattgcaagatattataaacagcttttgatgtcatgctagaagttttggactgcatgctataggagaggaaacatgatcaaaatcatgttttgatggcacgtaaagtggatgtgattgacagagtgatggattatacacatagataaaagacatggatgggttttaatgatagcagcaagagtggagaggaaatataagaagcttatctgagaaaaactttgtacacttgactaagttcagaagtaaattaaatgtggggatgctagtagaaggagaaagaggaaggaataaagataatctcaatttctagttcagaaacctatgggaatgcagaaatgtcattaattggtttgaggacatctgtaggaaaggagttctggaaaattggtgaggagaaaaagaaagagggatgcatttggttttggacatactgagcgtgcagttctaaggaagcatataagttttaaaaaatgagaaatacatgtctagagttaaggagagagacagaccctgtagatacagatttgaaagattattatcatctattacaacctctgcttgagaagagctgaagacatgggaagaaaatacctggggaaagagtacagagcagaaggaagggagtgcagaagaagaagtgggctaagcatgaaatcctaggaaaccctaagattaagtgactaagaagagataccattggagcgaaaaggggagataaaaggagaaccaagcaaaggttctttttctttgaacgtggagactagtcatcaaattcagtcattacagcaacctcaagtccatgagagctgtgaagtggatcctggatttggcaatgaggaaggcacttggtgtcctttcagagctgtgccattggagaggcaaggaccaacatcaggtagtagtgggaagattcacagtgacgtggagaaatggagaatgaaaagttctgttcagaaatttgctggtgaacacgtttagtgtacactaaaaatatttattgaacatgctctatatgctgtatattattatagctgaaactgcaacaaaaaataggatacaatcctgatcctcaatgagttcactttatatttaggggaagggaaacatgtaaatagatcatcagtgaagccatttcatcagtgaagccaatgcagtctcttctgaagaaaattacttatgaagaagatagattaaattacttatgaagacaaagaattcatagtatcaaaaactaaaaatcgcaatcaaactagtgtaagaatcttgaaggtttttcaattaactataaattcaatagtggtggattgacctgtatgattggagggctgtagtgctttataatttgaaatacagtgaacttcctggctttaaaaatgtttagtgtaattttcatttatccaccactgcctgcacactgaggtaattagaaaatttcaatatttgctccttatcagataatgcccccttcccattcctatgcagctctcttttaaaaattatttggcaaatgcgactgtcaaaattaggtcaaataaaatgataattgattgtagtttactgcatgcacataatagtctgtataaggaaaactctctgggtggggttgatagtagcagtaaagtggaggattgtgctttttcaagacttctattagttcatactgtcaccaatcgagacagcaattgtagtataagtttcacctttgtttgtagtgtggatatatttactttggtttgagactgaacaaagtgaaacaaaacaacaggtcaataaaaagtattatattgccatagaaattgaacagcaacctgaaagtccagaggaatagcatccttctggaacaaacaaataacatcaatcagaaaaggctatggaaatgtcaatagaatacaagaagatatgacacctgtaaaaataaaataaaatttcagacgtagaaatcaactccaaaagaattaaatagaactaacagtatttagttattcattcatttagttttactttttatgtttgataaaaaatttttactttctattttgatatttatttatttattcatttatttttactttttatatttgctctgttgcccaggctggagtgcagtggcacaatctcagctcactgcaacctctgcctcctgggttcaggcaattctcatgactcagccttccaactagctgggattacagtccaggcacatgccaccaagcccggctaattttttgtatctttttttttttttaaagatggggcttcaccgtgttggccaggctgatctcgaattcctggcctcaagcgatccacacgccttggcctcccaaaatgctggacatgagccaccaagccaagagtatttaaattttaatcttaataaaactcggtctattgttatctcataaaaatacacataactgcaattctcagcacaaacagaaaacataataaataactgacttatacagtctcttgaaaagggggaaatatatcctaggcaggctaaagattctttatcatgctagttgccttttttttttctcttccaaaatatcaaatctctctctctctcacatttcccaaagggaaaaaaaaagcagcctattaagtctcttatcagttctttagttatttctttaccaaatcaatttacttcttggcatctttaaattcttcccttcagctattaacctaagagacttcagcaagtctctaagaaactagaagatgaaaagaaaaatatcccagaaagggggtagagaagctgagaatacttacatgaaaataagctttactccagtgacactttggtacagtacaaaactaaatgaagaaatacaggtatagtctttgtcattcaatcccctgttatatatttagagacttgtgtgaatcttgcttggagtcagggtccataaatcccccattcagacaaagcagggagaacaacttttccccttttccttggtgactaaaacaaagggataaagacatgaactgaacaacaacaacaaaatcagagatctgcccttgagtgtacaaggttatcattccaatcaaactgttcctgaggtgtaatcttggttttgtgtcctctcttggttcatgccaattacttaaggttgattttccagtttttcatagtgatctgatattatgccagtaattaacttttgcttaaattagctagagttattttatttagtttgtaacaagaattctgcctaatatagaaattagtacagggagtggggttgaatatgtcatttgtatcctactatctccctcctgccacccccaccccaaatgctctgacacctcaaatgctctgaatatagaaactagtgcagggagaggcaatatccctcagggtgacaatgaaggtggcaggggggcttgagattttggggcttgagggagcttaggtgaggctaaagaaccacaaaaatattgttagctatggaagaaaatgttgctgcacagaacacactgaggtgaaaccaccacttacattatcatctggagtgaggtgctcacttcaagcaactttttgagagaagctactgttactgtcatagaagaatatgaaggacatgaggaattccaacacttgatgtaaagtgactatttccaatggtacaggataacataaagaaaaagaatagaggctgggcatggaggttcacacctgtaatcctagcactttgggagcccaagatgggaggccacttggagttcaggattagcctggaaagcatagtgagaccccatatctacaaaaattttaaaaattagccaggcatggtggcatgcttctttagtctcagatacttagggctgaagtgggaggatcacttgagctcagggagttgaggctgcagtgagtcataatcacaccactgtactccagcctggtgacagagtaagaccctgtctcaaataattttaatgacaacaataataaaatggatagctcaaatccctaaattctcaactcaaggaaaaggtccagtcccagggaacttctaagaccaagcttatagactttacaaatcctaccaaaagactgatatagccaaaatcaagacacatactttgattttgttggctaccaaattacagtgtcagttggattcacagccatgctggatctcttacagtgaatgtcagagcatttggggtgggggtggcaggagggaagtagtaggatacaaatgatagtttgggggacttatggtaagatttggagtaatcagaatttcccaacccctcaatctcagctgaatttgcattgctaactggagcacctatttctctttttagaaatctatttctccctccctggtatatgccatacctatttcaattaccttgtaatattaaactagttctccatatgtacctcatcatttccagacttatgactaaagccagagctcaacatgtctcagcaagttaagctttatgtacttaatatacaaaattactttacaggtctttgttcacttacatcaacaaaaatgtgtatcctttaggatatggattcttaggatatttatccaaggaaagagaatcgggctcaatttatcaatgtgtgtgaactcatcagagattctgaattttgagtgctggtttgagcaactgggtcttgtttcaattgtttactcaaacagctgacagaagtctggaatcaatgtcaggccaccgtaaacaaagttgagatagcagaattaccctgttaaagtaaggaaacaatccaaatactttgggagatatgaacttgaaagtgaatttagtgtgtatgaactccctgcctattccctaaatatattctctcaagagggcacagattttcccttcatccaggccttgagaaatatgctggtaaggggagggtcagtatcttggaaagttcctcaaaggcattgagactgttaggagacctcacagtgggaatgagttccctaaataaaactaccatgggaagtgttatgtattgaattatgtcctcccaaaattcatctgttgaagctctaacccccaacatgatggtttttggaaaggggtctttacgaggtaattaggcttaaaggaggtcctaagggtagggtcttcatggtgagattagtgtttttataagaagagaccagagagctttctctctctttctatctctaccatgtgtggacacaacaagaaggtggcaatctgcaagccaggaagagagccctcaccagaaacccaattagcctgcattttgatcttggactttccagccttcagaactgtgagaaacaaatgtttattatttaaaccacccagcacgtggtattttgttatagcagtcctagcagactgacacagggtgatcttagggtatcctagcaacgtagtcgaaactaaatcaagagcaaagcaggtgtggctgccctaaataaacagcaaggcagggtgttcatcagaagggtctggcctgacgacattttttattgtggctaatttacatgggatccctgtgtttgaaaagattgggcagtctattaagtgaataaaatattttttaacctaaaaacaccctccttctagtgagcagaagcccagcataagtcaccatgaatgacttgcacatttgatttccatatctaagctggttcacagacccagagctgaataaagagtagatcaggtacttcagagcagaatctcctaattggtggtcacaacacactggtgtgactgcaggggttacagcttgctgagataactgttttcctcagcctgaaataaatggatggcatgtgggcagctagagattccaggccaagtacaaccagttttgctgacttctccatttactctggtataccatagacatattattttctatgcatgccatgatgtcaaacaggctgaaagccctgtcttgtaggagcgacccagtaacaaaaatcataactacatataaacagtgttcctcctagacttttccaaagaaatactaatctctttacccatcaatctgtgccctggaaaattagatctacccaaatgtttcagtggacattgactttgaacttagacaatatatggggacctagaaagactgttcagtccattggtcagagggagagtttccaaagatcaaatgactgacggattttggtccaagttgtactactgaacctcagtaaaattttagaatagaggttcttatctacaaatatctaaatatagatatagatgaagatttagatatatatataatatgtatcttaatatctataactatctagttattcatatttatctatctacctacctatcatctatctatcatctctctctctatccatgtatctatctatctatctatctgtctgtctatcttactatctatgtaactatctatgtgtctatacacacacacacacacacacacacacacacatacacataaacacacataatttgatctctagaataaagactgctctctcaaccaaaattgtaattataaatcaataccatatcttgcaggaaggtaattaaaaatatgttgcattcaattgcagttattataacaggcattaatttaatacaggagcaaaataacatagctcttagaaactcatggattttttttcctctattccaccaagcaaagagcaccagaaacagttatctttgcatatgcaagggtgtatgtagaatttcaccatctaatctcagggctgtgccaatcctctagctctgagttttgtttagtctttaggaaccttgataatctcattatctcaaggtttagcatgacttccactgcacttatagcattctatagatatgccctaaagagcaggaagtgatagatatcccagatgcctcggtaagagccatacataccaccaagtggaagataaaaatagtaaaatacaacagtataaaacgcaatgctaaatccagtcagatttagcatgtaagctaacctcctccaggctaataggatttttttgtgtgtttattcttaccactaaaaaaagaatcccagtatttatgggcctttctgtattatatggggaaggaaggacactcctcatcatgttaccaaaatcattcataaaagttaatggaagtctaatgcaattctataaagacaggacaaacaagagcttagatccattatgagagaatatttaggtgatactataagttaaagtacctccaaaaacttaaggctttgggtataggcaaagggaattttgaattgggagtgaggagatgttataaatgggttcatggtcaactgtgcaaatgattctggtcttatttacataaaagaattcatggtcaattgtacaaataagatcctggtcctatttttcatgctaagatatatatttatttacatattttaattatttttctttttacttcttctaaattccctcagtattacaaaaatgatacaattaatctaaaatgcagattaccaaaaggagaacgcaacagaatttgaggaggaattgacattactcagttgtgtggaatctgagtcaggtgcagtaactcacaattttggagttgtctctctgtgagaggatgtaaatgtggtttgtgtcttagtgcaatacattattgtattacaggcaggaaccatttttgtgaagcataactacgggataaatcagatatgggataatgaactgtcataaaggcagagtaactagacatttgtcatgtgcagtctgtcctgcacctgtcccttctccttgtgtaagaaactctccctttcctcacagattgtgagatttggtgaaagcagtttccatctttcagcgtgcagaaagcaaaataggaagacaccccttcccctatccctctctccaggcagtcaaagaggatgtggagctactatcattcacttttggagatatgaaaaatgacccggagatttggagaaagtatagagggcaccagcagagctctcgcaagcctagtggcagcagcaaaacacaagaatccagtggtgtttggttaaatgcccagtgtggtggggccaatggcagctttggaacaaagctgatctggtgatatgacccagctctggaattaactacagaggttccatttgtttctctctagttcttaggtgggttctccagactgcctgtgaatccttgcttctgtcgtagggagagaaatccgatattggtgaagagcaatcagtctaccatattcccactagttattacaagtttaggctgacttcatctcttggtaccttaaataacaccctggtgaacttcttttatcaagtctcttcatagacctggatgaaatttacccaacaaaatgttgggtaaatccaaggaaggagggctgataaaggatataaacaagttaattagctaacattggcaaattacttctaggatggctgcaccagtttaccgatcttacactgcattttcttagctttgccatgcgtgtgagtgaatattgagttttcaccatactgttgagtggaaaattgtaacatcactatttatagttaaataaaattaggcatttgttcatttacttggctttgtttttatattctaaaatttcttaggtttttaagtaattttattcagtgctatatatacaatgtatatttttatacttacataatatataatatttatatgtaaatactatatatacttgtttatatacttataaatactatatacttatatatacaagtatattttatgtaactatattttaaatatatatttagaattagtttcctaaatttcttctaaaaattctacttgagttttcataggaattttattttgtatatagtgataatttctatggacaagagacaaactagaatgtggtcaggagaatcaggagtattgtgaggggagagtttgcaggattaaatagggtggtcaagataaacctcactgaagcagtgagatttgaacaaagacttgaaagaggaaggagagctagacaaacaggtgtctggaagtaaaagagatttctagagagaaggaacagcttcagcaagaacaacaaaaaagcaaacaaaacagcaaaaataagtcaaagcagcacaaaacccaaagaacagcacaaaggccagtggggctggaaaggagttaagtaagagaaaagagcaattggagaaaattttgaagagctgagggtttgggggagcagatcatgtagggcctgtagacccttgtaaggattgtagcttctactatgaatgaaagggaagacattgaggacctttgagcacaggagtggcatgatctgacctatagtttataaggagaactctggtataatgctgacaatagattatgaagaggtaagagtagatgtttggaggctatttcattaattccaaggactggtgttattgcctgagaaagggccgtagtgatagaaatggttcaaggtatcatattctgaataatttctaatgaaggagacactaggatgtatagatggattggatgtaggatgtagaaatggaagacaatgatagcttcaaggatttttatttgagcaatttcaagaacgtgactgctttttactgaaatgaggatgatgctggtgaagtaggtttagggaagaaaatgagttaagttttgaatgtcttaagtttgggatgtcaagtagacttcaagtggaaacatagtctccagagttggaggagatgggagacaggtatgggatagagatacaaacttgggtatacacaggcagtatttcaagccacgagaaagtttgaaatttccactgttcatagaggaaaggaataagaagtaagccctggaatgctctaacactagaaagtctggaagaaaaggaggaataattgagacacagaaggaggaactggaatttattttgatcacaaactttggaaatttcaaaactcttgttaacgctatagtttttcttctggttctcatggaatgattatttgcaaataatgactgttttagttaatgcatgtactccttaattctttctcttgtcttattacattatctacaatttcctgtacttcactgaaaatagcagtgatgggaggcatattactcttcccagaactaaaaaggaatacttctaatgtttattcgagtatgatatggtgagtgttttaacacatagcctttacaaactaaagacaggcttgtcttttctagtttcacaagagcttttacttcaaaggcattttctgcaactattgaaaagatcagtgatctttcttttagatctgtgatgatttaccttgatatatttccttgcgctaaattattttataaccctagggtaaatcctacttgatcacgatgtattatatttttaacacacagctgaattaaactagatagcattttgtttaagggttcatgtaatttcaaatataatttataatatataataatcatattttaatttggagctatataatttcttgttttgtactagtattatctggtaatgaattaaagatatataaaaccttgtacaggttttctggttttcaaaatcattttctggaatgagccatgtttaaagtagggataatgtgcttctttgaagtttgttacaggtcatgtgttaaattatctctgtggtttttttaggggaaatattaattactttttgattccataatgattattgtttacaaaatgttctattttgatagttttgtcaatttatgttactaatatttaacaatttcatctgatttaccctattcatttgtgtatagccgtacatagtattattttaatatttgtttttcatttttaattttttatttcaataggtttttggggaacaggcggtgtttggttacatgaataagttctttattgatgatttctgagattttggtgcacccatcacctaagaagtgcactatacttaatgtgtagtcttttatccctcgccacctttcacccattaccccaagtccccaaagtccaatgtatgacgcttatacctttgcatcctcatagcttagctcccacatatgagtgagagcatatgatgtttggtttttcattgctgagttacttcacttagaataatagtctccagttccatccagattgctgtgaatgtcattatttcatttctttttatgactgactagtattttatggtatatatatatatgccagtattctatagtgtgtgtgtatgtgtgtgtgtgtgtatatatatatatatatatgtgtgtatattctatggtgtgtgtatatatatatggtgtgtatatatatatgtgtatatatatgtgtgtatatatatatggtgtgtgtatatatatatgtattctatggtgtatatatatatatatatatatatatatagacaccacagttccaaatttcttggagcctttgttcatttttaaaaattttttttctttgtctttgacagattgggttaattcaaaagccttatcttcaaactctaaagttctttcttctgcttggttgattctattggtgagaatttccagtgcattttgcatttctctaagtctgtccttgatttccagaagttgttattattttttatttatgccatttcactgaagaattttcttttcatatcctgtcatgctttttatttctttaagttggacttcacctttttttgatggcttcttaattagcttaataatccaccttctgaattgtttttctggcaattcagagattttatcttggtttgggtccattgctggtgaactggtatgatgttttgggggtgttaaagaaccttgttttgtcatattaccagaatcatttttctggtcccttctcatttgggtaaactatgttagagggaagatttaggattcaagggctgttgttcagatccttttgtcccacagggtgctcccttgatatggtgttctccacgttcccctaagaatagggcttcctgagaaccgaactgtagtgattgttttttctcttctaggtctagccaccccacagagctaccaggctctgggctggtagtggggagtgtctgcaaagagtcctgagatgtgatttctcttcaggtcttgcagccatagataccagcacctgctttggtggaggtagcaggggagtgaagtaaactctatgaggatccttggctgtgtttttgttcagtgcattggttttgtgttggttaacccccagtcaggaggtggtgctttcaagagtacatcagctacgatcctataaggaggatgcaaacttgccctagggacacctggtaaagtattcaggttcctcaggcagtgagcagggccatagagcttccaagagattatgacctttgtcttcagctaccagggcaggtagagaaagacaccaggaagggccagggataagtatgtctgagctcagcctctccatgggtgcggcttgctacggctgctgtaggggatgttggtgcggttcccagtccaatggagttatattccctgggggattatgactatttctgttgagtcataccggtcaccagggaagtgggggaaaaccggcagtcacagtccttaccctgctcccacgcagcccgcagtcctaaaggatggtctcactcccaccacgcgcccacatcagcatctagtctatttccaggcagctggtgactagggctgagaacttgccccagaccacaaacctccccattaagaaagcaagcagacttagagtttcttggtgtctcagggagcctgccgggctgatccagttctcatctctgtttattccatttcattccctttgtctttttctttgttgttttccttttttctatttgtttattctgttgcttatcgtctaacttttgagttgaatcttaggtcatttgttttcaatattttttgcttctaatatgtctacacatacacacacacacacacacacacacacacacacacacacacacttacccataggcatatacacatatattgaaagctctaaatttttctccaaatattgctttaggtttttcacataaattttaatacatggtggtctcacagtcattcaaccctgcctgtgtttcttacaatttaccttgcaaatgcctttttaacccacgagtaatttcgtagtccttttttttttagtttgcaaacatatgggactattttagctatctttttgttatcaatttctaattttgtagcattatggtttgcatcatagtttatatgaagttgattcttgggaatttatagagtcttcctttgtgacccagtataaatttgctttttatggcttaaaagaaaggatatcatacctttgttaaatgtaaatctatatatatgaatactaattcaagcttatttattgtattgctcagatctttcacggctttgcctatttttatatttcaattttgaattttttaaagaatacttaaaatatgccaattttaaaaatttctcttcataaattttctaattatttttatatattttgacttaaaattggtatgtatatatgtgtatatgtgtatttttatattgcaatttagaattttttaaagaatagttggtatgtttatgtgtatttttatattttaatttagaattttttaaagaatacttaaaatatgccaattttgggccaggtgcagtggctcacgcctgtaatcccagcactttgggaggcccaggcaggcaaatcacgaggtcaggagatagagaccatcttggctaacacggtgaaaccccatctctactaaaaatacaaaaagattagctgggcgtggtgatggatggctgtagtcccagctactcgggaggctgaggcaggagaatggcgtgaacccaggagatggagcttgcagtaagccgagatcgtgccattgcactccagcctgggcgacagagtgagactccatctcaaaaaaaaaataggccaatttaaattttatcttcataaattttctaattatttttatatattttgatttaaaattggtatgtgtatatgtatgtatataaggtatacccacttggtttaagagtgcttttctaccagcatataattgtcctttagaaatttgtttaatgtgttttaacatgaaatgcctggttttaatattaaaatttcaatatatttttaaagacagctttgtttatatttacctggcatattttttatcttttttcttttttttactttatgtgttctttagcagttggcaattattagcatgtatcaaaagaaaaaatattttaaatgagaaaatggtcatttaaaacatgtctctcataagtcacttatggcctgaaagggattaagaaaacccaagctgagagtctgtcttgatcaatgagatcatatttttactgaaaatggcatttttttcagtttttgttctaccattttgttttctgttttatatcaatcaggatttttttttcttccctaccttccctatctcctagattaatttttggtttttgttttgagagttacaatttctatctttatttgtctgtagattactcttattaacactcatctgtcatttagatcttgtaataaccgtgtcttgcaagtatatgcaaatactttccaaattttcactaagtttatgtttctttttcaatattctattttattctgaagtcttgcatcttttctttcattatgagaaattctggactattttgtcttccattattttttaaatttcattttactttttcctcttcttcttgaactagttttagaagggtgaaatacttgtactcatatcttttccatcttattttttcatctcttacatttcctgtgcccgttagaagagatctttgctcaaatattccagtttactgatttgtttgtaatctgtgtatacagttgaaccttgaacaatgtaggggttgatgccttgtacagtcaaaaatacacatttaacttttgactcccccaaaacttaactaatagtctacagctcactggaagccttattgataatacaaacatttgattaacatatattttgtatgttgtttgtattacatactatattcttacaataaagcaagctatagagaagaaaacgttattaagaaaataataaggttggctggatatggtggctcacgcctgtaatcccagcaccttgggaggccaaggtgagtggatcacctgatgtcaagagtttaagactagcctggccaatgtggtgaaaccccgtctctactaaaactacaaaaattagccaggcatggtggcgggctcctgtaatcccaactactcaggaggctgaggcaggagaatcacttgaacccgggaggcggaggttgcagtgagcaaacctgggtgacagagcgagactctgtctcaaaaaaaaaaaaatcttaagggagaacaacaatatttagtattcattaaggggaagcgaattgttataaatgtcttcatcctcattgtcttcatgttgagtaggctgagaaggaggaggaaaggaaagggttggtcttgttgtctcaggaatggcagagatagaagaggtggaggagttggaaggggagacagaagaggcaggcacactcagtgtaacgtgtattgaaaaaaatccatgtgtaatggacccttgcagctccaacctgtgctgttcaaggctcagttgtagtccgctctgcaacccatatgttagattctattttagcagttacactttcaaacccaatatcttccattggttttttcttaaatcattttcctatgtttttatcatcttctcctacatatctgagaatacttattattctttcttaaatttcttgttttgcaggactataaattcttctttttgaagaggctcttcaatttgttgtctgtctttcatgtctgtaggcctggaggaggagtaagtaaaaaccccagtttgttcccattttcatgagtttaggagcaagggttggaggcctgtctcaggacagaaagccttggccttgaaattgaagctttagcttttgccattgcaccccatctcaggtaatgttacgctctacgggaaacctgtggtttcctctgttccagtcaccattcttttccaagagatgatattgtcacctgcagttgtctggcccagaaggtgggagttggttagaaattaccgaggcattgaccagcttgtttccagacattatatctgtctctagcacagctgattctggtgctggagagacatcacccagccctgtgcatggcactgtgggcactgctgctatcctgcctatcctttataacatgttaggaacagaacaatgtgaaggagactaatgtgccactagaatgtcttccccaagctgagccccatatttgtggcacctcgtcctggtcctctctttttacaggatgctgttcttctttcttgcagggacacaaccactagtttatgtgtctcacagaggttcctgctgttttgtgtcaagacagatgttgcattagcttccctcttgcttctgtgacatctcttcaattgggttccaaggttggaggacatggctcatattagttcacaaatttgttcataactggaagcttccccaattctataaaacatacaattatgtttttgatacataaaaatgattggcaattgctaagctgagtaaaatattgagtttctcttggctccagatgctgcaagaaagtattattaaaaccagcctggtctcagaaaagaagcctaaaaattaatctcacatgcctagaaaaatctgttggtataactgttttgactattctgaccaaagtatttccagtaaattgtacaacaacactaccacacacgtgggatagctgtatacgagaatagagatactttatttcagggtcagagaggacagttaattttgtgaagcaccagatgcctggacaaaatcccccgtcaggggaaatgaaaaggaatagtccagttctctagaatcaaagaatgaggcaattagaacgaaggtatcatattgggataataagcaggtcaggaaccaacaatagagctccgcagtaaggagggaagaaaaagaggaaggaagggaggagggaagaaaagaaaaaggagaaaggaatgtaggaagaaaggaagaagcctgtcataggagacatttctaatagcataaaatgcaataacctttagctaagcatcaaattagactattgaacttgtccctggacaggtgatattctgtctatttctgaattcgatagtaatgaaaaggacagccagttgttattgagcacttcagtgtgccaaatactgtgctaaggatgttactgacatcaccctgttcagtcctcatgaaatgtatgaggtcagaattattttctactcttattttacagatgagaaaactgagcaagattttgtgactttcccaaggtcctacaccaggcagagtaggcaaaatttaaacctagaaaatttgactctaagattacattgtcttgtaatgcaaaggtttctggagattctgtgaagagttcagaagtggttaaaataacaactttacgtgagaagaataagacaaatgaagaaattctgaaggattctgtattcatttttcttttataacagtattataaggcattttaataatggtctgtaacctagatatcctcttagttaaagaaaagaagatcctttggagctactgccacggaagacttttcaactggaaaggatttgaataaaaagttggaacatttaagttaaataatgcaataatacaacaactgaggaaatttattggaatgtcttatcaataaatgttatagagtctctttttctcctttaaaataaaatagataagattctcccaaggatgatttaattgtggttctgcctagaagaggtgagatgatttggtatgccgatatacaggcaaggggaccggcgggagggtcagaggatgaagggctttcgctggaaggaatgggcttgttccaattcctgaacctgcggatgtggaccttgtttggaaaaaagcctctttgaagatgtaattaagttaaggatcttaaggtgacatcatcaggattatcccgtgccttaaacccaatgacaattgtcttaaacgacagaagaggaaaagatacagacacagcgaaggctatgtgaagatggagagagaggctggatttatgcagccaccagccacagaacaacagcgacagccactagaagttgaaaaggctccaccttctcacggagcatttccttgccgacgccttggtttcaggtttccggcttctggaactgtgagaaaatgcatcgctttggttttaagccacaaagtttgtaataagtttttatgacagccctagaaaactgatacaggtaaagatccagatagtatttccaggaccatcggtatctcacagggaactatgggaatctttataaaatgaaatgttgacataatcattaacaatcctaatgagaaggacagggctgaattatctaatgaaatacatgtgcccgtgacgtgcagaaattggacatgcaaaaatgaaatgaagggtacataaccaacgatgctggcaaaacagaaacactgtgcggtgagactcctcccagagagcaggccttggcgttttattaaccctgacacattcaatgttttaattttgacctcagacaaagccattaaagcatacttttgaaatttaagaatgacaaagctcaagaacaaactaatatgttgaaggatcaccattaatagaccaaattccaaattatgaaatgtaggtaataataacattcattattagttactgagtgcttattatttgttaggtgctgagataattctttagaagtcattaaaccatttcattctcaaagctacaccctgagattgaccgacatttgtcagtggggaattgtggccactaaataacttaatgttggaatttttttttttttttttgagtcagaatctcactttgccacccaggcgggagtgcagtggcacaatctcaactcactacgccgttcgcctcatgggtcaagtaattctcgtgcctcagcctcctgagtagatgggattacagcgtgagccactgtgcccggctaatttttgtatttttcatggagacgggatttcgccatgttggtcaggctggtctcgaactcctggcctccagtgatatgcccgcctcagcctccaaaagtgctgacattacaagtttgaactaccatggttggcctagcttaatgttagaatcttaattgagaaccaatacctaaaattaggtagataacagtctggtgttactttgcacaaaacagatctcatcacatctgaagaacggtgctgattgggcttcctggccatagaggatcatactgggtagatttcaaaggaaaatgaaaacatctggaagctaggtcatcataggcttcatttgttatattgtatggtgaaaaacagaatatacttatttttgcgtatccaaaggatagaactaggaagagtggtagaagttacagagagaaaaatgacaactctaggacatttttttgataattagcacagtctagccaggaaacaatctgcctctgcaatgagagatctctctgcgcttccagagcaccacagcagcagcagccaaatgttataggaaagttgcagtaaagattcattcgattggacaatgttgagctgaataatgtctctaattccctttgactcatagactctgtttctgtgagtttctggcattagtggcaagtggggaaaggtgacagtgatgtaaagagcctggagatgtaaggaaattcaaaagagcaaacttcattttacaatttcacaaggtcccttaataatccatcagcaagtcagatgaattagcaagatagttttcacagctgtctaattgaatgtgtagacacagtcttagcaaggcacaagctaagccctgactaagtggaaccagttaagactaggctgtggacactgccacatactagttttgtgactatgggaaagttacttatcttctgtatcttacctcagtcttatctgtaagatgagaatgttaatagtaccttatacagtttcttattgtaaagattaatgagttactcaggtagagtttttaaaactgtgctttgtaaccacaataaatattgccacccaagtacacattgaataagagcacaaacaggtagtacatgacatgaaaatcacattttgcacttagaagaacatgtcatgctctagtgcatgggcgtgaggttttcaggcacttactgaaactaggaaagaagaaagatggcagagatgaacgtttacttttctcttggatttgaatgcaagtggtaagcctgcttagagagtccctaatacaccaaaataaaggaaaacattgatgtgatactgtgtctacgaagtgaaaagacagggaatttatgaaatacgaagaacaatttgcagtccaaaatgcagagctaaatttctgctctgctatttacctgcggccacgagcaggccacagagcctgctaaagctcagttgtctgttgcataatataggaatgaaaatatctggcctgtgcatttcacagggatgtaaaattcaaatgagagtgcaaacgggaaagctcttttaaatcgtaatgcccagcaccagaaagtgttgttctgacgtgttgtgggggtaaagtagttaagttcgtcaaacaaaacaaatgatctgattcccttcataataacatatgtaaatgttgttaccttaagttatgcgaacagagggaaagtctgtgtggattcaggcagctgcatgtatttttaccaggcaatatccctccactcagggtacctttgctcaaccgagcgtgtccagatacagtagaagtgtttggagcaggagatagaacgaaagagagggaaagaagacattattccttccccctcctacttctagctccaaacctgagtcagaaatgaattgtgtgtgtatatgtgtgtgtgtgtatacagcatgtgtgtgtgttggagggtaggaagaggatagaggagagagaagtttgtaagcttcatacaacacaatatgactgaaaatgttcatgcccaaagatgagactcttctttaatatgtgaaagggaagccctaggaaatcactttctagtattttctaggggcaatcacaggcaatccttctgactgaatgtgaaaggcaacaaaaaggaacaataaacattttgtcccttgtgttcccaaattcaaggtttatcatttcgttgatattttagctagtcataaattctcagttcaaaattttccctcagaattttgaaggtatttctccaaaaccttctgtcactctgggttgttgataagaatttgggagccattgagatgattgcctttttttttttttccttttggggatcatctaggatctttgctttattcttgatgtgctaaaatttcacagggaggtgccaggctgttcttagtcactgggatagaaactctataaaatcaaggacttggtttttttacttctgatttcaggcaccttgtggcaacatgtctggcccataataggaactccataaatattcatcaaatatagttttgggatgaatttgtattgtgggacacttgaaggagacatttaatctgaagaatccatctttattttcataagctctcctaccctttatttacccttctacaatcccaataatgaggtaaagtctcccaatttgtatagatcctatggtaatctccacaatccaaatggttgaaacagtatctctgtgcctcattgtttttattttttctactcagggtcatccagtggcttcatttattcaaataagcatcctttaaagcaattattcattctgagtaactgaatggagctcagtgtagcaaagcagtctacaatctgcttcgtgattacctatgacatttcttgggcaaaataaactacatttcttttttcatgaaagtggctacatcagcaaagacccagagcagtcaactcactgatgacagtcacgtgatttcctgaatttcacaaataagttgtcagttaaaaacaaaacaaaacaaaacaaaaaatgtctatggggaccttacaatttctaagcttttattcttccaggaaatgatatttagaatgcaactaccatctgatattgccattatttcattaaaaatattaaatttcaatccctaaaacttaggatgtatctacaaagggaaaaattacagcattaaatgcatttttattttttatatattcttctttatacatttattcattaatggagtaattgactgattcattgtttcatttcatttcataaaatcttttttgtgtgtgtgaataaggattggtctgtggtatccctgacactaaaataaacacacacacacacacacacacacacaattgttctagggatctgacttctatctagattcagttcagaattttgcatctttccctgttcttaatttattgtcttttgctatcatttgacataaagagaaataaaatatttgcacttcttcagaaaattatttccatgatgactgtattaagtaccagcagtaatccaagacatggaattagagatgacattttttctacttttattttgaaagactccctattttttgcctgaagaagagaaataggcaaagaaatatggataattatgaaagtagtgaagccacatctgattcctttgagatatttttcaagaacatttaatccttttaagcaatgttactcttgtcttattgccaatgtcagtgatagcttggataatcctctagctatgaactaactgtttaaatgtgacctggcaagtaacatactcattctgtactctaacttaatattgcaacgtttgtcattcatagtaaattaaaatatattttaccacacttgctctttttccagttattcttttgttgttgttgttctagaaaagatattgatgcatttgctcttcagaacttgaatgttacaaacatactttgcacatgcttctgagaaggaagtttccatgtaactcatccaaaacttaagtggaggagtggtggatttgaactgactctccagcaaagacaaagcaatagcattttcaataaagatatgcaagtgaaattaagaattatgacagaggagaataaaaacaatagatcagtcctcctttgggagaacaacaacataaaaaagcaatgaaagggtgcaaatcattgatgtgacacttaaagcaagccattgcacatcttacacagtgactggccctagtagcaaaaagccagatttgggaagtctctgaaaccacagtttcctatgttctctttaactgagtaggtttactgcatgaatcaacccttcaatcccacacaccctccaccaaacttcagtagagacaagaatggccataaatagccggagagtaattcctgttttttgctttgttttgtttttgtttttgtttgggggggggggggttgtgtgtgtttgtatgtgtgtgtgtgtgtgtgtgtgtgtgtgtgtgtgtgtgtgtgtgtggtttttttttttttttttttttttgacacagagtctccctctgttgcccaggctggagtgcagtggtgcgatcttggctcactgcaatctccgcctcctgggttcaagtgattctcctgcctcagcctcctgagtagctgggattataggtgcataccaccacacccagctaatttttgtatttttggtagagacaaggtttcaccatgttggccaggatggtcttgatctcttgacctcataatccacccttctcagcctcccaaagtgctgggattacaggcgtgaaccactgcacctgcccattagttcctgttagacactgcctgcaatatgtgcaagggccattccactgagtaaattgtataatcttaaagtgaacttccttattgtgataattaatgatagaacatatgaaccataccttaatgaatggaattttcccttctaacctctttggcatttgcttgactatttttatgggagaagattatcccccaccaacctctgtctccctctaatctgcctcttctgctattagacttaggcaaccctattacggcagagcctctgaggagtttctaggcatgaaatcccagaaggaaccctggatgctgtagactggatgatggagggcagtgaaagtatgcatacctgtgagtttgtacatgagaggagtggctggggctgggatgagaactctttttgcttgcctgttagagctcagcttggatgggttggggcagctgtctctgttctctcaaggttagagccaccttcacctcaagaacttttctcctgtatttgtttcaggtaattgctctctgtggaaagctttttccacccaagttgaaggtggacagaggtgttctcctgttggcctcagtgtcctactgaactgtggctccctctctgccctctggttgtagccaagcatgagccagttctatgaggaaattaaaaaggaactctttgatgttcagaaaattcaaagaacaaaggcaattcagcctgactctgctttgctattaattgggagttgttactgtattggggttgaattgtgtctccctgaaagatgggctaaaattttaacccatggtacctcagaatgtgaccttatttgggattggggtctcttcagctgtaattgcatgagatcatgctggagtaggatgggcccttaattcaatatgactagtgtccttctatgaagtggggaatttggaacagacacagagaactccatatgaatatatgaagacagagacatagattggagtgatgctgccacaagtcaaggaacacctagggatacccgaagctggaagacgtaaggaagtttcctctcctagagactttgaagagagcatggccctgccaacaccttaatttcacatgtccagcttccagaactgtggaacaatacatttctggctttaagccacccggtttgtagtcttttgttataacagccttaaaaaaaactaatacaggagtgtcttagatgagtttaagttaaaaggagaaatcaatgaccttccccaaactaccactgtgtgtccaccattggacaatggacaaaccaccactgtgttgtccatgtatggctatcgcattttacattgttccagatattcctcctggaaagaaggctcaagggagaagataagatgactacctccaggcacggttgctgtacctttagcaaaagctctgatgcaggaagccccttaggctgttctcagcaaggagcagtttttccctggagctagatgtgtatcaatgcctgattccagcacataccctgaaggaaagatctctcttttacaaatggtaaggcctttccctagctgagaaaggaaaaagtgagtccaacatttcatatatttagcagtatctctatttctagatattaattacatacaacatcattccctattatttgtagtgaggcactaattatccaagcatagtgatcttctatgattcaagatgaattaaacctcatataattaatacattcagcacattaaactgcaaaataacccacctttaaatgagagaaagttcacgtgaaagacagcatatacacaagattcttaaatatatttcaaaagaaaagtttcatcaataagtgaacatttctcaagcagacattcacagttacaatatttcaagatacaacatttgttttcttcccctaaatggttctatattcttttcacactacgcggtgtatatccctgaacaaatctggtcaaacaaaacagatcattttcagctctatttatacaatactcttttctatggagatctaagccaggccaaggttaaggatacttttaagagaatgttatcattttaataatgttcttagtggcaaagactttctactaaataacaaaggcccaaaataggggttatatataagaggctcactttccttaatctctatagaggtaaataattgaggccctaaaactgtagtgttggtttttatcataaagtgtcaacttacaaatatttatctaaatggttggattattactattgggaaaattatgtgataaattctttgaggatttgttcacttatccacaatctcacctccaatgtatattatctaagaaaggctgggcaccgtgccaagaactatagaataaatagcctgagccacgagtagtttctgctcgtggggttatagtttgaggatataagaaatataaatatcaaaatatcacattatattggtgccagaactgtacagtcatgttattcagccacatgcaaggttgtttgtagagcctgtgaggcagatgagctgagtgcctgaagacagacaggtctgaggctaggaataacttcctggtgtttccaggattaaacaccctggcaatctgagaactagagtacctcctatccataaagtcattttctttatgacctggttaatagtgtattgcccctgaatgcaaaggtggaattatttcagattaccatagtaatttttaaagtgaagtggaagtgggtctgtaacaacatttctggatgcaaagacagctgaaactgcactataaagagccatgacaaaaagaaggtattggccttgcctgaattcaaagatgaagaactgtgatcctctcccatgctggaagcaggatatccatcacagatactggtggactgtaggatgctcaccagccgtagtgagcacaggggtcttatagtttgtatctacttatactaacatgttcagttcttgcagatgtttctgttggctgtgatttccagagcattttatcacggggatttgtttacttatgtgtcaggttatttttgatggtgtgatggtcattgtagttacaaaattatttttaagaaactttgagacctaatataactgtatcattttttaagagaaattttgcattagcttctgctaagcaccttggggcactaccagtctgagaacatcttaattaagagtaaagcttcaggttccctggactatccagaggacacacacttgggctgcaagtttgcacaagagctaattaatttctagttcagagcaactctgggtgtatagtcattggctcctagcttaaattggaggaggatgtaaattgattttccacattaagtggtgcctggcgtttgttctattcttcctgaaaggccaacatagccagctgttagcttagtagctgtttcttctaatgaataaaagtccacagcacagagtttttttatatagtaggcttacatctcaagagtattgcatttttttcagatttcggacccacaattctttactgttatttcagtgtttttttttaatcatgtatattttattgacttataaaatttgtcctcagtgggaaggttagttcaaatgatcttccttgccatgagtcagaagtccttagatcagggttttgcattcttagtaccattaacattttgggctggacaattctttgtttgagggcactgtactgtgcaatgtagacatttagcaatgtctctggcttctaccaactagatgtcagtggcaccctcctcgcccccacaatcatgacaataaaaaatgtctccagacattgccaaatagcccctgggaagcacaattctccttagttgagaagcactgccctagagtattgatattttaaaataaagatatgaagatatctgtagtgtgttgtgaattaaaaataattgcattctggttcatttgcctcagatttcactttgtgatacagaggacatgggtctttaagatccagtgggaaattgcagaaacaatgtggtagagtggaaagaacactagctttggagccagacaggattggattctaaacctgcctcaactgcttaccttgacagaatactaattgcatggcctcaggcaagtacttaacctcttcaccctaactttctacttctgtaaattatgattcctcaaagggttgtttgtgagtaatttacttctcattttggttcagttattcactcagagcatgtagagtatgtaatgctaacttctattttatttttcagatattttctcaagtataagctctttcaccgaaggctttgttgaaaaaaaaaaattgaagaaaatctattgacctaaatgtagcaatccacaaaatattttatttaacttggattcttaaagactcagtttcgattttactttaaaaatattttacaggttgggaaaaaagggcaaagaaaattttacacaaagctaaagcagtgcttaatttttttggtatgttttttcacattattgtataaaaattgaagaggtagaaaataggagccttttgctgtaaggtaagtgataaactttttttaattttataattttaattttctacttcaacttgaatcacagaactcaatatattctttatagttataaaagagcatttaatgagcaacagtttccagacaacctggcaagtttttttttttaatgtgttatcttatttgattttcaccagaaacatgtgaggtaagtgctattcccattttacagattcaggcatctcacatatatggaaggtgtttatccacattcacccagctaaaaatagtctcagatttgtctgcctcagacccagggttcttaaacactacatcatgtcacctctgataactaaatgcaagaaaaggaacaaagatttcagggataccaataaatcatgtcctatgggaggaacatgagcttcatgaaataaaatgggaaggaatcttgaggaaacacagaggttcatggctgggtgtggtggctcacacctgtaatcccagtactttgggaagccatggtgtgaggatcacttcagcctaggagttcaagaccagtctggacaacaaagtgagatctcatctctacaaaaataaaaataatatttttttatcttttatgacaaatacaaaataaaaatggccccagctacatgggaaatcaaggcaggaggataacttaagcccaggaggttgaggctgcaatgagctctgctcataccactgcactccagcctggatgacagagtgagactctgtctaaaagaaaaaaaaaaaaaagaagttcaggatataaaaaacagaagacagaaataaacaacagaaaaagatggaaggtggtgtcagaacatggatttatagataattcataacacttatcagacagaccaaaggaaacatctttatttttaattcggtagacactcctacaacatttattcagttttgtatgcttaaatacaggattataaatgataccttcctttccaccaagtttgcttatagaaaatgcacctccctttgacacagagacaagcttcttaatcatcagataagttctagcatttggacatttatggaaccaaagaatcatattttaaagcttctgccaagtgcagaagtgctcaatgggcattttgtctcagtaagaagcatagatttagcccatagatcttagatagaaaagacctttgagactctcaggtggattttgctgcctgggcagaagaagtaataaatgttattacacagagactctaaagaccacgcttcagcaatgactgcttagcaatatctaacacttcagattgtatttgtcaagtgaagattaagtagctcctaagccatttcagagcttgtctcccatttcaccatcagatctgctctccctctcagtttatagtagatactagttagttagtataatttttccttctaggtacctacatttttctatttggctttgcatatccaggtactattcataagttgctattagatggggtttagccttagttctatggactcctaacagggacttaatttacagtctatgaatgggtatagaaatttttcaagagaagctggaaatttatattttgatgttattatctctcttgttttaaatatttgcaactaatcccaaatttgcaaatgctatgtgcttcacacagagtcattctgtggtctgaatattaatggatctgggggttgccagtttgccacttctgaaggcaaacagaaattcaggtgggattgagatcacctgggtactctgtgtgaatattccacaactgaaaagagaaaagaaagaatgaagtttggggtcaaactgtcttgggagttgatagctgtgtctttggactagttacttaatctttcttattctctattctaattggacaaagaagataacgggacctgtctcactgggttgctttgaggaacaaataaaacagcccatgtagccacaaaatggtaaatgagaatcagttcaatacgtgtttccattgtcctgatggattccagtgatgactggtttaaccagagagttatcaagtgttgtgttggaaactcaaataatttgatgcctatagaagctttatataaagaagaagaaaggggtagaaacacagtatgagactacagagttggggatagagtagcactggtttcttaattatctgtgcttgaattcagagatgtatttgttttcccattcccagttagcctcactgttcccaatttattgtccactgatgaatggcaatgttcataaatttggaaaacagagcttcatttttcataaaggattgcagcctacagcgtggccattcttacaggctgggaagcacagcctctggtcagaagccaaaaacagacacctggagggaggggcaaagagaacaggaattcatgtgtttgtggggtgactatacatattcaatgaactgggggggagttatgaatattcataaagcaagagcacacacatacacaatgcagcttcatgccttttcgtgggacccatgtccaaaaaatggtggcattagcataattctagggtggagttttcagccctcagatgtcaaaaagtgaagcagaggacataaaagccctgtctttgcatcctccctagattggccagaaccactccatggtcggtggtctcttaccaggaaggcatgctggtcagatgttgtacagaaaccacaaaagggaagagcagcagtcaggcctttggttgaaatcagcggtggagccagtctttccaaagggctggcttctctttagactttggggtagtaagcctaatggtggttagagagggtgagggtatagtgagatgtgtctatcatggccagaaactcagttttcaaggtttttctggagtccccttggccaggaggagcttctttccattggtttgggggtgtaggattgcatttttatttctcgttacttaaccccattgctttattatcttgcctccttagaagtttggaattcaatgactggcacttgagaacaccctctccacccccactagctcctcaggctggagcttgagctcctcctccccagggggcacccaatcttgtatcctcttctgcagccttcctccgcacagggttctaagaatgagtacacagaaaaagcatcatttagactctgatgcccctgagtggcaacgaagctgggaagccagcaccatcagcaatgggtgactctcttattcctggccgtggcatagcaatacataagtacttgatgccattctttgtagttagttttctatgagatgtgaagaaatatgttaggaaagctactttgtgagtctcacttgatccaaaagaactaagggaaggcttttttccaaactaggtccccagcctagaaacagtaacttgggaataacaataacctgcaagtggaaaatgaaataaaatgtgaatgttgctttttaagtgagcacattgacctggttagacctcaacattaaaataacacaatagcaggaaatgattcaaatgtatattttaagagaatattgtgtaggtatacacatacacaccaataaattttactgccaaattatgcaatctgtcaggctatagattacttggtgaaaaacaaatcccaaatataggtgctgtgtggaacgcaaatccatttcagtaaggtgaaacagatggtgactgaaatttactcaactataattactatcgaagttcaatttgttgcaaagaaagcttatatgtttgtcatttgaaaaaaaagttttaaaataaatttgaagtaaataaaaaataaaataaaatgaaataatataaaattgacagtaaaatgacacaaatttaaaatatttttcaaagagttgccttgatgtactcaatctagtcattgattgtaccctttgattttaattcatccagtgctaaacttccttcacaacttcccaaactactaggtacttcattcgtatagaaactttattctgggagagacaaagttcgactctgtcacccaggctggagtgcagtgatgcaatcatacctcactgaagcctttaactcctgggctccagcaatccttccacctcagcctcctgagtagcgtaagccagcatgactagctaaatttttattttcatttttgtatttttatttttttacttttttttttctttgagacaggatattgatctgttgctcaagctagaatgcagtgagtgaggcatgaccacggctcactgcagccttgacctcccaagctcaagcagtcctcccacctcagcctcttgcctcccaagtaagtgggactacctacatgtacaattaaaaaataaaaataaaaaaattgtaaagacaaagtctcgctgtattgccagggctggtcttgaactcctgaacttgagcaattctcccacttttgcctcccaaaatcttaggattacaggtgtgagccaccatgcctggcccctctttaattttttgtacagacaaggttcattgtatgcagttagtctatcaagtgttcattggctcacaaaatttcaaatacatctgtgttaatttttggtttcctgtaacttagccccagaatgttctcagctgaggttctgtgagttccaatgtgttgaatggatgcagccaggaacaatgcttacctagaaaaaacccccaactggctctcagagctgaagtatctattgcaatgcagaggggaaaggcaactccttcaacattcatttcagataagtcgtttctcatcaatacaactcttgcacacagaattaacgtgcggaaatattgaaaaaatgcatttattatgtaataagggaatgtgatttctattacatacctcttttaatgatttcaaaggggtataggaattgtttaataatacatgtagttatggaatttggaaacatattcctaactataagacccaagagatagcaaaaaataaaaagcaatattgtttctgtaagttgtttgcattttctatgcatcaataagccataaattttaagaagtaatgactggcgtgaactcaaactttgtactttcagttaaaaatcttagctggtgacacattgcagaagataagactccatcttcctcttccaaaacatatatacactcctctccccacttatttggctggtttgtcccattttatagtagggttgaaatatttcaagctaagataacaaagtcaaattcaaggtcttgttagcacaacttggggaaatgccaagcatagcagcctgctattcctgacaggtacaactccatcagtttcttaaaagagagaaagaattacagaatacgccatagggaaacagagtaaactccttggtgagttgcaatcactgaattatattctttggcaccttgtgtttatatcttttatggagccactaaaaaaagatgacaggactgaaaataaaatgcaagccttagtagaaaggcttctatctggtcagtcactactacaagaaaatagaggatttgagggatttgtccaagataaacacaagagagaattgtgcaatgtaaataatactgcttaaccttctctttctcaactaacagactgtctttaggctctgccagccgtccagacctcttcctcaaggatgtttccaatgtgtgttttcattgtgctactgtcaaactctgtagctcaccctaggatgtgggctcattatttctggattggttgaacaaagtttaagtatgtgtgtcatcagcaggtagagaatcagagcttctccaaggatataacctgaaatatttgtcaggcaaacctcaacaaatctcatgtttttaagtgaaaactcacatttataaaatcagcattgctttctattgccataacttccttagactttcctcaggaaaccagaaaacttttggaaaatataagttttgtcctagcagactgattacttatccttgaagcaagcggaatatgaatttttaaaagatattttttcttgtatttgcttctaggcatctaggcagcttctcagcaactgtgctgggcagatgggaatctagtctattaaaaaaatatctgctgagaaatacacttcacagctgcccatttagctaatgttaattatttgtaatgtcttttttaatgcattagatattatattgcacagtgtccaaacccaagcccatctttataattatatataattatctgaaagaaatatgtttttaagtcaacaatcatgcctaagaactgttttaaaacaagcagatgaatgtatatccataaacatttgaacagtagtttgaaatatttagaattattattaaagcaacctatagaatgtgagttaattctaggagaaattatagacagtgggccaggtgtggtggctcactcctctaattccagcactttgggagactgaggatcacctgaagtcatgagttggagaccaggctggccaccatggcaaaatcccgtctctactaaaaatacaaaaaaaaattagctgggtgtggcggcaggtgcctgtaatctcagctacgcgggaggctgaggcaggagaatcacttgaacctgggaggcaaaggtttgcagtgagccaagatcacgccattgcactccagcctaggtgacaagagttaaactccatctcaaatatatatatattattttatatatatatatagagagagagagagagactgaaaatggtagaaaaaataaaaaagataaggaggaacagtgtatgtggggctcgtctgaagcaaataatatcatctgctttgtttcgttaatcagtggtgaatttgctatggctggcttacaccatcgttcacgaaaaggcaacgtgcaccagagggcccttcattcctgattaagcagccttaaagccatgtaggggtgggcttgggatttctgattgtttagtcaggttcacaagattactccccttccattcacaaaaggagaattctaaaagtatggagaatagtagtgtgcccagaattggtgggttcttggtctcactgacttcaagaatgaagcctcggaccctggtggtgagtgttacagctcttaaggtggcgcgtctggagtttgttccttctgatgttcggatgtgtttggaatttcttccttctggtgggttcgtggtctcgctggctcaggagtgaagctgcagaccttcgcggtgagtgttacagctcttaaggtagtgcgtctggagttgttccttcctccggatgggctcgtggtctcgctggcttcgggagtgaagctgcagaccttcgcggtgagtgttacagctcataaaaacagtgtggacccaaagagtgagcagcagcaagatttattgcaaatagtaacagaacaaagcctccacaatgtggaaagggacccaagcgtgttgccactgctagctcaggcagcctgcttttattctcttatctggccccacccacatcctgctgattggtagagtggagtggtctgttttgacagggcgctgattggtgcgtttataatccctgagctagacacaaaggttctccacttccccaccagattaattagatacagagtgtggacacaaaggttctccaagtccccaccagagtagctagatgcagagtgtcgattgttgcattcacaaatcctgagctagacacagggtgctgattggtgtgtttacaaaccttgagctagatacagagtgctgattggtgtatttacaatccctgagctagacataaaggttctccaagtccccaccagggtagctattggtgcattcacaaaccctgagctagacacagggtgctgattggtgtatttacaatccctgagctagacataaaggttctccacgtccccaccagactcaggagcccagcttgcttcaccccctggatcccgcaccagggatgcaggtggagctggccggccagtcccgcgctgtgactccgcacccctcagcccttgggtggttgatgggactgggcgccttggagcagggggcggcgctcatcagggaggctccggccgcaaaggagtccatggagggggtgggaggctcaggcatggcgggctgcaggtcccgagccctgccccgcagaaaggcagctaaggcccggtgagaaatcgagcgcagcgccggtgggctggcactgttgggggacccggtacaccctccacagccgctggcccgggtgctaagcccctcattgcccggggcgacagggccggccggctgctccgagtgcgggcccgccaagcccacgcccacccggaactccagctggtccacaagcaccgcgcacagccccggttcctgctcgcgcctctccctccacacctccctgcaagctgagggagccagctccggccttggccagcccagaaaggggctcccacagcgcagcggcgggctgaagggctcaagtgctgccaaagtgggagcccaggcagaggaggcgccgagagcaagcgagggctgtgaggactgccagcacgctgtcacctctcagtagaatgggttttagctaatgacaagccttgttaaactgccccaggtgactgctcagtctttgcctagttaaggcttagattctcagcaatgtatagctagatcatcttctttctgttttgcatatcctaagccaatgggttagacatgtggatacaggagttaaaaaggaagtacttagatagcaaggaccataggagtcctcggtaaggctttttctttttaatgataagcagccccaaatcattttctaacaaatagcagcctgcaagctgggagcttgcactggtgaatgctggcaggaactaaggactagacattttcaaaatggtggctccatcttcccttctccgccagccacatgtattgtaaggagcagacaagatggcgcccatcaactggaaagtccatttgcataaaaagattagggtggggcaaccagccttcctcatgcactatatataggtcatacctgattgaaccaatctgtgagccctaggtaaattagacatcacctcctcaaactggacgataaaactcagggcattggatgccaaccactcctttctgctgggagaccccttctgctatagaggaagctgtttctctttctcttctcttctacctattaaacctccagtcttaaactcctcctgtgtgtccatgttctgaattctttcttggccaccacgtgacgatgaaccacgggtttacaccccagatgacataagctgcttcaatattttattatatattcattaaatcaccatgtaagtgtcctgaactataaatgaatggctggcatagaaatttttatcattgacaataataaaagaaaaggaaggcagaaacgtaacgctacttgcataagagtcattcatccagttttgttgcatacatataatttgcatagaaaaaatacgacctcactaaaattccatgatcctgattatgttgtaaatatgagattatgtttcatctttgactggaaactttgctttgcagctggatgaacccacctgaattcagtccacgaataggagggagatagttgaggaatatttgaaagagatttggctcaggggtcaaacatttgactagaaaaatgatttcttctactaattggcgttgtaaccttgcatatgtcactttatcattttgcttcagtttcctcactgtatatttgtctttgttttcttattttctttctgtaatagtttttaactcacagcgttgatgttaggattaaagagatagcatgtgtaaacaagaggcacatgattaatcttcaagaggcagtcaagtgcactagctaataacacagattttagagcaaacatacctagatatggatcctagatctgcctcttattggctctgtccctagacaagttattgaacctgtgtctcagctcgctgacctgtgaaagaggaatgacagtcatgcctaggattgttgtgcagattaaatgagtggctgtatgtgaagtacttagaagggtatctgagaaaagaatagattggactgggcaggctggaagagggaaaactgggctcctatctgggcaatgaagtgttcaaagggcagatatgttctgaatgagagtggcaacaggagagatggaaagaggaggtggaataggaaatatattttccatagatagctgctggcccatattcaggtctcactttaacatagtttcacttctttaccaaggatttctctgtcatacgctgcccagaataaatcagggaacaccaccttctccttcataacacttatcacagtgtgattaattattaggtttgggcaaaagtaattgcagcttttgattactttcgatgacaaaaactgcaattacttttgcatcaacctaatacactcctttaagccaagtcccatagtctcttttgcttagcattatgtctctggtatctaatagagtagctggcatctaattctaactcaataattacttgtcaaatgagagaataaaatgggtgctatataatctgctaaaaaagagagaaaaaaatcctaattcccagagagattatagacaatgaaaagattagaaaaaaagccctttgaatttgttattcaaagtttgttgagacagaaattctagaaatagaagattgataaatccagctggaatcaatggagcttatgctcatccccaaagcctatacccacctacttcctttcttcccagtgtagtgaatgggcccaaacatcaatggctccactcgtgaaatccttttggattccgtgccacttgtgaaatgctagtcaagtctgcaagatttgaaggtggtatcttgttgaaagcatgtaagaactcatttcccaatctgtgcaattctcttgggcaatatccccaaccagcattgtccagttgtatctgatacagacacagccaggtcaggaaggctgcagaggggtctgattgcttaagacgttggggaggtgtgttggagaagaaatcctcacagcatagcaatgactatgctaatgctcatgcttcaaaagacatgagcaacattttttcttcttgcaacaggtgtgcatccttgatttcggctttagctgactgactgtggactagtgtcttctccaagttcagagagtctgaatatactccaagttaggagtatatttagcatccttgatttcggctttagctgactgactgtagattagtgtgttctccaagatcagggtgtcttaagggttaggagtacctttagctaccagcttcttatctatgagttggaagaaataatcaagcctaccattgttgaggatttatggggcttctgtatgtgctatttgcactcattagactggttaatccaaataacttgtaggagtgatttattttccactgagttaacccatagtttgaattaggcaaaatgacatattgttttcctgttatataaacacaggtaatttgtaaattaaggatcaatgatcagtgtgaaaagatagatcacgtggattaaaataagtgttttaaaaacctgcatggaaagaaaatgtgtaaagagaatttatgtcatcttctccttaacaaggaatcccaacctattaccagcatcttatagaatggaaaaaaaaaaaaaaaaaagacgtatgtgtgcaatgctgtacacagaccccaaacctagaaacagcctgatgttcttcaacaggagagtggataaatagcacataaaagataattatacagcacagaaaaaaaagacagtgcctggcattgatactaaggattcatcttaagctgtatcttattaaagtcaaaagttaaacatgagtgtaatttttattttattttattttacttttgatactgagtttcactctgtttcccaggctggagtgcagtggtgcaatctcggctccctgaaacctccacctctgggttcaagtgattctcctgcctcagcctcccaagtagctgggattacgggcatgtgccaccacgctgggctacttttttgtatttagtagagacagggtttcaccatgttgttcaggctagtctcgaactcctggcctcaggtcatccacctgctttggcctcccaaagtgctgggattacaggtgtgagccacggtgcctagccaaaaataagtataatttttaaatatccatttaggagcctatttgcatgtctctatatatcataaagccacataaaaacaagggtgtcaggatattgattgcctttaggttgggtggaggcagataggaagggaccagaggaaccataaaattggaggctgatgactgtctcactgtaggtttcttttttctttttgtaaggaaacaaaccacttttaaaacgtgggcaaaacatttgaatagacttatcaccaaagacatgcagatggcatgcagcctccagtttacaggaagtgaacaggagaacaccccaggtgatccattgatgcaaacagggagatctagaatgtgggtatactaaggacaactgatctggtttttcaatgtaagagtgtgttttatttattttttatttttctaccaataggaaattattttttatgtatttatttatttatttttcaactttcgttacaggttcagcaggtacacgtgcaagtttgttgcaaaggtatgttttgtgaggctgaggtttgaaatacaaatggatccatctccctggtagtgagcacagtacccaacagtagttttgtccccctccctcctcccctctcttatattccctagtggccatcgttcccctctttgtgtccatgtgtagtcaatgtttagctcccacttataagtgagaacgtactgtatttggttttctgtttctgtgttagttcacttaggataatggcatccagctgcatccatgttgctgcaaaggacatgatttcactcttttttacgactgtgtagcattccatggtgtataagtaccatattttctgtatccaatccagagttgatgggctcctcccctcaagttataccttttccgttttaagaaggatttgcttcctgacattcccctggcactgccctcctgggcattctctgcccactgagctctctcagggtactggactgaagggagacccaccgagtccaccacacgcagcccagtgtctgacagtcagtagatgctcaataagcacttgtggtacaaacacacaggtgagcaacaattactacatctttatctcgcttcacagataaaaatgtcttgcctttgactccttttccagtttcatatttctctcagcagagaagaattcgaataatacctctctttttctgagaacaaaattcagttgcagtgttatggattaattgaagtcttatggaagattagaatatttttaatggaagaagtagataaaatgtgttgaacttacaaccaaattttgtgtgaaatatctatactgttcttattttttacaaacaggaatcgtctttcttgttttaaatgtctccatccatgtcaaatgtcaatgatagtttaagtaataggggtctttttatttaaagcagaatgtagtacttatactatctaactccagagggtcaaatgaagtggaaataatgtattcttactaattatgttaaacaaatgtgtatttttttaaaaaacactatctttggataaagaaaatgtggcacacatacaccatggaatactatgcagccataaaaaaggatgagttcatgccctttgcagggacatgaatgaagatggaaaccatcattctcagcaaactatcacaagaacagaaaaccaaacactgcatgttcttacttataagtgggagttgaacaattataacacatggacacagggaggggaacatcatacacagggacctgtcgggaggtggggggtaaggggagggatcacatcaggagaaatacctaatgtaggtgatgggttgatgcgtgcagcaacatggcacgtgtacacctatataataaaactgcacgttctgcacatgtatcccagaacttataatactaaaaaaagacactaagcttaaaaaaaaaaaaaccactgtcttataatgctatcaaatttcaataggagcaattaaataacagcagttaaactaaaaagagataaaattgctttagaaaagagaaaacacagacaactcttctgttgcaattatgggtgctcagaggtcagctgctgtgaaggtggagtcaaaccttcatgtgactctggagtcaaatcttcatgtgatcccatcacagcttcaagctctccctgaagattcaggggctttcctaatgttatcaggacctgtgagctgcatgcagaacagcaggagaaaagggtcactggaaaagactggaattaaaactctgttttagccaatatttatctgttatggtcattttcttttcttgactcattgagagttctcttggtcaacagagctgccattcaactttcttaagccctttcccatagaagagaacctggttttgataggaaagaatcattctttccaatttttggcccaggcctttggccatcttcccatagaggttgcacttctgagatgtgtagttcatgctaacatatgctttgggaagtttgttctctgtttctaagcagcacattttgtccttagctgatgttctctgaagcttcattatatgttcttgatgtattttaggcagtatttgaagtttcagctgaagcttctgaatcccactttcaagctgtgagttttcagactgcaaagacacttgctcagtttggagaccttttatttgtcctgtaagttattcatttgtttgatttttttcagaaaagtctttgaatatttcttatttttctccttgaaggcatttagtggaaacatctacattaatagattccatgagtttcttcaccttctgactgctagcctaggtgatctccattttctgattcactctttgtctctaattccacgttgctatcattcatttaatctttaaagagatcaggaaaatgtgtgatcttcagcacggtttcagtcagacatcttaattttctctctttgttatttacaaccgttttcattcctgggtttgagttttcaaacacttttttctgttctttaagctttgcttccatactgcagtttcttgggcaaacagttttagactttcccaaagatgagtattttctttcaaagtgtgcattaatttattctgaagcaatctgcctccttctgagatacttttaagacctttttttttttttgcatcagtcacttgagattggaggattttttttttcgtttttttttgttttgtttgtttgttaacttttagagacagggtctcactctgtcacccaggctggactgcagtggcgcgatttcagctcactgtaacctctgtctcctggattcaagtgattctcctgctcagcctcccaagtagctgggatttcaggcatgggccaccacacccagctcatttttgtatttttgtacacatgaggtttcgctacgttgccctagcctggtctgaagctcctgggctcaaacaatctacccgccttggcctccaaaagtgctgggattacaggtgtgagccaccacatccagccaagattagtgggattttgatgcctttttgagtgatcatcattaacctatgcaatgaaaattcaagctcacttttctgtccttttccaaggaagtctcctgtgtccctaagtgaagacctgtttggacttttattacgtgctttgaaactcagagtttattgctttgggggactggctttcaccacaggtgacttgagggcttgataggcttctgtaattattcccatcttttcactaactttgtgatattcttagatctgggcagaaagtcttttggccagcttatccctccttgaagtctgttggctgtttactataaaaacaacgacagcagcacacaccaggatcttccagggaaatccaaagagacctgagacttgtctcaagctttaagacaacaccagaaaagcaccccacagctgctctgagaccagttgggaggatagctttgtgacagaaagcaggctctccttggctccaaagggcactgcagccccgcctctgattaccagtatcctgtaggccacagctgactgcatggaaccttagagagtattgccttaaattcaaacaagtgcctggcaagcaggacagaccaccagttgggctggggagaggggaaaccaaccaggttctataaaacgcactttgaggctgggcttggtggctcagcctgtaatcccagcactctaggaggccaaggtgggcacatcacgagatcaggagattgagaccatcctggctacagtgagccgagactgtgctactgcactccagcctgggtgacagagggaaactacgtctcaaaaaaaaaaaagcactttgattttctctgcacacatagaaagtggtattattatccagtgcatttggggaaatggaaagatctgattgcagccagagaccaccttggagcttgcaccactctaggccccacctggccatacagaagccccagaagatcaaagcagtgttatgcttttcccacttctctgcacatgggcatcggggggcatgataatgggcctgaagtagaagagggctcatgtgctcatatccctgggtgaggtgaactctcttgaatcaaagtttctctctgcaacagaaaggcttgattctgtcttaaaagtacagagatctccctgacccgacggctcccactctcccctgtgtttgctcagtgcaggcaggcagacacagaagactgaagggtctcactagaggtattaattaaaagaactaaaagaggtattaattattgaagaactctggggagatcagttgaaactgccaaggtcttcaagtttcatggactttctgtggagcgagttagtccttgtttgatccaagtggatggggatgagtctcctctggggctgacttcatgatccaggctccttccctcatgtggccctgccattttccacacatgcctctcaaggtcaccctggagccagtctccaatccacagagtcatcttcagaaagtgtgctgctgcgtagagagcagatcttcttttggctaaatttgccacttttaatttcttcaaatcacatcttattctcttactatctttccagtagactcaggctaagagcctccttgtccatcacctgggtctctgctgtgaatgattcctccctagtacaacttccaggattctctgtcttggtctgtcctaagtcagaaaaaaaaggcctctgggtgtctgtaggtagagttcagttctcagactgacagcatctgtagttgcaggcctgtgctgggagatagtcctattgctgctaacacaaaaggtcggtggctcaggcagccctggaagagatatggggctactcaggtggagagaattacactgcacagcaatgcagggatggtcttcttctggggcattccagcagccatacctcagggcaccatggcccaaagtcatgttgcagatgagaagttgctgagcaccaacaaggaaaaatgcctggaccagtagagctgttgggcagagcttccagacccaaatcctactagtcatacccttatgggcgacgatgtagctcactgggtggagttaatgatgtgggggctggaaagggcagaatggcaggctggaaattcaggtaagagttgaagttgtggtcttgagtctgaaatctgtacgacagaccagcagggtgagaatttacgcaggatttttatggtacattcttttttttctttctttttgttgttgttgttttttttaagagacttggtcttcctttgtcatccaggctggaatgcagtggtgtggtcatagcacactgctgcctcgaatccctgggctcaaaagatcctcctgcctcagcttcccaaagtgatggtatgacaggcatgagctcccacacctggcctctatggtacattgttgagacagaattccttcttccatctttctactttttgatgtataattttatttcaactacactggagaaaaggaggactttcaaaagtaggaaaaatacaatctctaacaaaaaataatagtgtaaaatggcaaaaaggaattccctcttctgggattgacagagatttacaattcagaagtaacctgcaaaatgtaactgagaaagctcaaaggaagagacaaattcccacacttgatctaactctgaaagtacagtttaggtaagggatggccttacacgttgacccagggcaggcacacaacatgtctccagattgcaaagctcagccttgggaagggagagaaaatgatgaaaatgttcaaaccttagatttcctgcaggcttgacaaatgaagcctgacatctcacctgattttgggagtgtctgctcttctgcagcaggtcttattttaactatttgatcctaagagtagggatttctcagcacaatataattgtgacaaagcacttgctctgacgcagaagctgttgacctggttggtgccaaggccaactttgagcagatttcctgcgagcagatgggtcaaggaaagtttttcactgatgagtaatttatttaatattgccacattgccctcctccttttctgggagtgccgttaacagaatgctccctagacttgcctgaatgacattcactgccccagtgtgagaatattattattattattattattttgtataggataggtttgcttgttaaggatgttttgttatttcagcagccttcaaacatgtaataaataaatttcccttgggttggcccttcctctcatttcctgaaggaggagctgattgttctcacagctcccctgggatatttcaggccgtcttcaaatgactaaagtgatgatgacgtcattcccttgtgcacaccattcacgtagagaacccggggaaggtcatttatagtatcagcatcaaggctgggattgtctgccctggatttctctgaagctaaagaaaccaccacatgaagtttccacagaatatggtagaagaggcttaaactcattgagatgctcctttagaatatttgccttgcatagtagcatctagagaagaataaaaagacttgattatttccgaagagaatgaggacagtgtgatttccaacacaaagtgcagctagttctgcctgacactggacaaaaaccattaagcagataagccttgcaaacataatggacatttctggaagatgatgacttctcttcagtgctatgtaattagatttgagtgtatgaagcaaaggtgctaaagctatattgctgcccactcaaaatgattgaatgattatgcaaaatttattcctcagaagtgtgggatgctcagagctcaattgcttgcagtcctgaaataagaagctataatttgacagtcacttaaactgatgtttttttcaataataatgaattgttcattttgtaaatgaaccccaaatcctcagtcctggtaactgactaaacattcctgcaccctaatttcagggacataattatgtaattatgaagttattaagtaaagccaaaaaaatataaatataaatgattctgagggttcagggggtttatctaacatgacaacattattggaattattattaacgtgagtttctacaacatttatttccataagtgttccaaattattgtgctttttaaagtttttctccagggagagaaacaacaaaaaaggggagtgcgctagaaaaaaggctcttcctattcttttcctgttcaaaattttagctgatttgaatgctacagatttatcatttggtgaatcctatatgttctcctttttcactccaaatcaaatattttattctttttctattatctacagtattaaagtatattctattatatttagaaaatataaataaaataaaagaagaaaaatattctgaaatttgaaaccaatattgttaaacttaattttattatgaaaataaaccgggccaggtgcggtggctcatgcctgtaatcccagcactttgggaggccaaggtgggggaatcacgaggtcaagagttcaagaacagcctggccaacatggtgaaaccccgtctctactaagaatacaaaaattagcttggtgtggtggtacatgcctgtaatcccagctactcgggaggctgaggcaggagaattgcttgaacccaggaggcggaggctgcagtgagccgaggttgcaccactgcactccagcctgggcaacagagcaagactccatcttgaaaaaaaataaaaaagaaagaaaagaagctccactccaattacattgaattttacagatattctttaaagtatagcaatggcatgcccttagcctattaagtgtatttgattgataatttcagtacataatttattctcaatgcaggcttaggagttagatcgcctgggtcagattttgtgattcatccatcacagctgtgtgacctctggaaaattacttatttttttcatgctccatcttcttcacctgatataatgaagtgtggataatagtacatctactttctagggttattatgaagattatctgaatcaattattgaaagtactaagaatagtgcttagcttatcctaagaattcaataaatattagctatattgatagcgattacaatagtagtgtgcaaaacgatacttaactaaatatcttagtagatacagatagctgggtgaggtctaattcttgtcctcaatgagtttatagtggaataaggcaaataagtgaatgacaataatataaagatgagaagaaaattctgaagtatttgatattatgtcggggttaaagaatcattaatccaacacacattctgaggtacccggggattttggtacctgtgacaagttttgataaatctaatatgtgttgaattgcttaggacaaaattttgatttgagagggttcaagaaagcaagagactagaggtacttgaggcatccaactataaaccattttatcaaggaattttgcaacaatgggaagcagaaaaataagggtaatggagaaaaaatgtggtgttcagatgtttgttctacttaagatgggagatagaatcatataatttaatgatgagtgactgatccagttcagagaaagaaatagatcatgaagaagagagtagaattgctggaatgatgtcctctagtaggtaagattggatgaaatctagaacataagtgagaagttggccacaggtaagatcaggagggcaacagcttaaaaggaggtaattttggtataacagaagctggtcaatgcacagatattgcgaagaacattgtggcagtgcccttctgattgcttccaagttttcagtgaaaaaaagtagctgaaagtaaagattggagatgaaatattaggtgttctaagagggaagaaaaggtatacaacaattgtctaggagactgagggtgcatgtgggaagatgatgagcaggtacagacttgggttttatcagggttaaagtgtttgccaagagtgcatatgagcaacaagggaatagttataattaagaagtataaaatttaatttaaattagatcagagagatatgatgtcattaggaggtagctggttaatggttagcaattctcaacaagctaaagatagttgtaatcagagggaatgataaagaaaggtctcatagagtggaatgcgtggaattgatattttagagagattgtggatattgaaacagacaaggcccagaatatggccatgggagtaagagaatgagataggtggagtaggagatccttcattcacttattaactaaatattatagacaagaagatcaaagaactgagaagacaggatattatgtaatctatatgagttttggtgttgtaatacaggattgcaaagagtaagagtcatccaggaaagaactcttaataaagacttttattaagagtttagtaggtgacggccatatggagggaagtgcatggagtgtgctgatgcgtaagctgaagctaaaggacttgaggggggtagaggggagaatggtctcaagagtaaggcttccttggtctggaggtgccagggatgtggccaagaaacagtcatctctgaagtgagccgattagaaaaagccatgctcttaagagaaagccatattttggttagagttaagtttaaagataacagcaatttttctgactactgactttaaattctgaagggtacagtggaagaagggttttagatgttgtagaagaatggagagaagttagaaaaggcaatgtaggttagaatctgaaggatgacatgactggggagaccttgaattcttgcgaaaagcaagataagatgatttctcaatattttatggcagagagtgatagtgaggcctggattgctggatggaaggagagtgaagctcttgtcaggaggacatggagatccaggaggtcctcttcattcaataatgatgatgtgaaagagggaatgagttttctttttctttttctttcttttcttttcttttctttcttttttttttttttgagatggagactcgctctatcactcaggctggaatgcagcggtgcgtgccatctcggatcactgcagcctccatctcccaggttcaagcgattctcctgcctcaggctcccaagtagctgagattacaggcacccaccaccatgtccccctaatttttgtatttttagtagatacagggtttcatcctgttggtcaggctggtctcgaactcctgacctcaagttgtcacctgccttttcaaatccagagaaacagagttcctgagattcctctggactggtgatgttgccaggaggtgagaagatgcactggcttctctgatacagtcaggcaaggcaggtaggcaggtttgacataaatcccgggtcaagaatggccatcaaggtgacttattctacaccagggtcctagggtttctccatcttattactatcaacattttttgctaagtaactctctgttgtgggggctgtcctgtgagttctggaatatttaacagaatctctgacctctacccactggttttcagtagcacagtctcagttgggacaaccaataatgtctccagacattgccaatgttctttggagagcaaaaaatcacctccagttgagaaccacttgtctaaatctatgtaaggaatcatgagagcataggagacagggcagtaaactttattgggatatatcaggaaaggcttcacacaggaagtaataattttctgggcaatccaaacacttggggaaagaattcacagtgaggaaatattaaaagaaacttgatgttgctgtttattaagctaattgagtcattaggtgggaccgtttctaaatgagtgggtatataaattaaggacccttatgtttgtttagatttgtaggatgttgacatgatcaaaaaacactcattgttaccgctttgtatatagaatgaagaaatcctatatcttccttaaattaccgcttttcgtgaccctgaagtatacaactattgaaaaaaaagacacaatcaattcatatgaaaatgtcataagagtggaatttttttcacagatttgtgactgcaaacagatggtgaaaaatcatgagaacgagtctgttcattgttgaaactatctattccaaaagatagtcctcatcaaagttagactctaagtcacagttttagaaaatatttgagctggtttaatgctacccttttcatcttcattcttagtttcctcttaatgtgtcagtgcatttttatgtctagggtattgcataccaaagttgacattaaattcaaaacattgcttatataaactcaaaattgagataattacaaacaaccgcataattgactgttcagatatttttcattcagcatcttggcctcaagtaaatatagcgcaaatatgacgttaaaacagattgtgccttttcaaacttctcatactacatagcagagcctgtacaatggactaatctcactatttacaatgctttaattcttacgttcaattcttgttcagttttcaacatctattgtctttatgatgtaataacctcctaactgagatagattagaattattttgtcctcaggaatgcatagagttgctaggagcggtgacatagtgaaagtttgggactcccttatgtgactcagtgcactgactcagtgtatctttactcccctaggatggtcctctagatgatcttcaccttgataactagattgacataatcagatgggaatgataatcatgaactgaacccactgtgggaaaagtcacttagttcaagctgataatgcaaaggcattcttcatatcatttggttttctcctttcccataaaaagatagagagaatgatcattttggagtagtctgccaacagtgttctgatctttaagtaaattttaggtaattagagatacactaacatattggattattataaatgtgatgcctttaatcataagaatactatttgacagtatttacttttgaggttttccaaaagtatgttctcctgaaggttcttcaatagtagtatcaatttgggaccaacagtgtgttgtagaatcactaataaagtgaatttttccattatgcctttgagagagtaccatctaaaaaaatcacaccataggacttcacttctgggaagtagacatactttttccaatttcttcctctaagaacaactaaaagctaattatatacacaaaacaaattctgaaaagtggagaaaagaaggatgatggctaggaacctcagaacccaaagaataaaacaacagtgtgtcccctgggttttctttcacctcatatatcccagacttggagatgaagaagcagcaacccagactggccaacaggtaaagacaacagaaacctcagcaaagtttgctgtctctagctaaactcattaagactgtgtggtattggtaaagggataacagataaatcaatggaacagactagctaaaggaccagaaaaagggcagcctagtaagaacacttttagacaataactcctctgctctagcagaataccgtggaaaaaactgtggccctactcccgcccatgacaataaagaccgaatggatagcctagactgccattctcaccactgtaatgaggtgccccaacccacctggcagtgtgagatcagagaagcctgggtagggagctggaactttcatccctgctaagtggccatgaagcatccctctgaggtagtgtcagtggagaccttgtgaagatacaggacttccccatctgtcagtaacggggcatctctccccatccctctcccctgctgtggttatgaaagtggaggcctagtgtgagactttcagcaaagcccagaggaggtgagacgccacctcatggtgtcaatggtgaacaaatagagagactaaagaagaaatttctacccctcccagccaaggtagcatcagaggagagccagagggaagacagaacctcacttctagccaggattaccaagtagcccctccactttgggtgtcaacagaagtcagctggggtacctggatttctacccctgcccatttgtaacaaactggcacccctcatttccccggctgaagaggtattagaggacaccagctaaaataagtttaaataagatcaaaagtcttctaccatcataccctaaatcttagtaaattttaggtaattagagatacactaacatatggcattattataaatatgatgcctttaatcataagaatactatttggttttaattaacattacttgtcataccaagatacagtaaaaacacaatttgaataaaaaatgtcaacctatagacaccaacactgagatgacagacatgtttgaattctctgacaaggattttaaagcagatgccataaacatatttcagtgtgtaattatgaagacactttaagtaaattaaaaaatagaaattctcatcaaatactttctattcttttttttttgataagtctttctatttgttctggaaataaatagaagagatgaagaagaaccgaatggacattttagaacttaataatacaaaaagtgaaatctcaacagaagttagaatgaagcagctacccaatccggaaagcagaaaacagactgggaaagaaataaagagcctaaaggatctgagggattatagcaaaagatctaccattggtgtcattggagtcctggaggggtaggagaaagacagcagggaactgaaaaagtacttgaagaaataatggctaaaacattttaaatacatcaaaatacacaaataatataatgagtggaattactctacccaatttcatgacatagtatgttgttataatcatcaagactgtgtggtattggtaaagggataacagataaatcaatggaacagactagagaacccagaaatatatccaaacaactatgctcaattaatttctgacaaaggcacaaaagcaatttgttgaaggaaagatagagttttaaacaagtggctctgggtcagttggctattcatcagcaaaaaattgaatctctatctaaccgtcatactatatataaaaattaattcaacatgggtcaaagacttaaaagtaaaatataaaattatgagatgtaggactaggcaaagaattcttaaattcaacaccagaaggacaatccctaaaaaagttgataaattgtacttcattgaaaatgcactgtgagaggattaaagaggattgaaaggtgaggattgaaacacaagctacagactggaagaaaatatttgcaaaccatatatctgacaaaggactagtacctagaatatataaaggattctcaacactcaacagcaaaaaaacgcaaacaagcaaacaattccatagttacaaaacaatgagtattgggtgaaagccacacaaaaggaacagaacaaaatagtgtcttccgtgtttggtaaatccattgggacttaaaactgaatttcttcctgaatcatcagtgtgtttccaaagtttatttgaagtttttccttttagatcaccatgtatgaaatttaattttatgtcttctcaacctattatggaatatctgacatgtgatgacacattattttcttaagagttaagacaagagttcctcagggatgcttgcatgtatcaacctcagaaagtcatttagtattgtgtagttttaaggtaatcacagataaaatgattgttttacattcgtatgtctatgaaatccttgtgttaatcagggatattggttactaaatatattatagaagaaaatacttggtttcttaaataagattttttttttttttttttacagaataagaactcattctagaaatgagttggattttttttggcaaaaatttattactaaatgatttctccattttttaaatcactgacatttttatttcctgatgaaaatgaattgtacaggtctgtcaaatatgctgaccaaacttcaggcaagttgagaacttgacattttttgccacctattttgcccaaattgaattggatattcctttatgctctttaaaaacctcagtgtgaaccagtgtaaaatctacctatcatctcactgattatatattttcttgggctctttaaaaattatataaggaaatttcacagagcaaacaacataaagtttgtctggtggaacagctaaaatcacactgcttcttttattacattattctttatcctggaactttatgtggggtcatttactagcacacactttccctctttacacttaaaaatgttagactcctttcaattccagctttattagacatatggacttatatagaaatacgcacaaaatgtgtccaaaacatttccaaaatgttacttctctataccctacttacatactgaaagtgttatgctcttgtacattcatggaatatccatgttatatagcagaggaatccatttgttaaaattgacatggcgttagggaaagtcttataacctagaaaaaaatctcaaaaatggtatctttattttagatctgtttactattcgtttaaaagaatgacagaaacatgaactgctgccttggcacacatgaaggactaattagtatctcttacttttacccaaatgcctgaggccacacaatatcctggaaagaaaacagaaaattattagggagcgtatgttttagttatgcctctcccacttgcctgagactgttcgtgattaagtaaacctttgtgtttcaatttccctatcttgtaaagtcctgataatatatgctctgctaatttcctacagatttaatataaatctgtgttttttacatagttggcattattccgagtactttacatgcacggaggaataaaattataatgacttactgtgctttgcatttccaacatttctagctccctctgtcttttccccacccacttctcaaatttagggacttctcaagacgttttatacttactgccctcggggtagagttcttacagtagtaatacaaggaatctactgagcatacttgttgctgttgttttaaagtagacttttgagcctcaaagtcaagtccatgtcattgagacaaaatttttttgagttttcacatgtatctattgaatagcaagagccaagcttccctgtctaaacaataaacagagaatatatagtaagagctaggctttttcctccccagccacctagattgtatttaaaattccacaggttgggaagaagacgagaaattacagagggaagagtacagtgaggttctctgtacagggacattggatggccctggccccatctccagagagccattggttggattaggctttagctgagataatctaaacagagctgtgcactccgctttctcggaaaagtgaacaagcagggtgcgggctcttcctgatgtgtgccagccggtggtagcagcagaagtgtagagatgccggcatgacttgctgaggcagaaaaggcttgaggaaatttactgagtctctgcagtcttgaacatcatctgtgtttcttacaagcccacaagactagggatagccaaaaatgaaactgtatatctgagttccttgagagtcaggtcaaggaaaatagagattgtgttgactagcaattggagaattccagaaaagcagacatctaagcaaatgacagtgtggttggctgacctcatccaaggaccagaaagtgcagaaattcacacagggcaatatggaacagatgctgatatccaggagcaggtgttctctctcagcaccacaatgtgtaaattcctcatggctaagatgctacttggttaaatttaaagtctgaaatgacaaaatttttccgtagttagccaacattatttttttcatcagatatatattacctaaaaagagagataaaatcacattatagacaaaaattacattatttattaaaaatgttaaaaaaaattttttacatataaaaaagttaaaaaaagttttttgcattactgaataaatgggatgaaattcatgccaatctcacacacatgattttaatacccacaatagttatgtgaagaaatgattattattattgttctcctttttacatagggaattgtaggctttggataagaaacttgcccaggttcacacagatgatatagggcaaaactgggaaccaaacaaagtatgcctggttggggagacctaattcttaatcaaaagaaataatgaatgtggtaaaatttgcaaataatgtgctacaatagaagttcatgttacatacttattacaaaattatttttgtagtctgcatatcaaagtatataatcaacagagtgaaaagacaaaagacaacctacagtgtattagtttgctggggctgccataaccaaaaaaacacagactggtggcttaaataacagaaatttgttttctcacaattctggaggctggaagtccaagatcaaggtgtcagcagattaggtatcttttgaggctttgacacatggccatcttcttgctgtgtactcaaataatcttgcgttggtgtgcatacatatctgtgccctaactttctcttctaaatggacaccagtcaaattggtttaggatctatcaatatgatttcatttcaccttaattacttcttgaaaggctttaccttcaaacacacattttgaggtaggggaagttaggacttcaacacatcaattcagtggggacacaatttagtccatcacatgtggtgtaagagaaaacacttgcaaaacatatctctgataaaaattgaatatccagaaaacagatagaactcctgcactaaataacaataaaatataggctaaagacttgaatagacatttcgccaaagaagatacacaaatggtaaagaagcatatgaaaagatgctcagcatcactcatcattagggaaatgcaagtcaaaaccacaatgagatatcacctcacacccattaggagagcttttatttaaaaacaaaaaacagaaaataacaagtgttggtgaggatctggagaaattagaatccttgtacattattggtaggaatggaatatggtgcagcactttgaataacagtatggcgtttcctccaaaattcaattaccatttgatgcagcaactctgctttcaaatatatatccaaaggaattgaaagcaagatcccaaggagttactggaacgccattgttcattacagcattattcactatagccaagaggtggaaacagccaagtgtccatcaatggtaaatggataaacaacactgtatgtggaatacacatacaatggaatattattctgccttaacaagaaaagaaattctgacacatactacaacatgaatgaaccttgaggacattatgctaaatggaataagccagtgacaaaaggacagatactatatgattttatttacatgatctatctagagtagttgactccatggagacagaaagtagaatggcagttgccaggggctgggagttgggggggtgtgtgggaggggagaaaataaggtgctatggtttaatggatgtagagtttcagctttataagatgaaatgttctggagattggttgcacaataatgtgaatagactttaatgctaccgaactgtacattttaaaataattaagacataaatttcatgcaatatacactctagttttacacaatttaaaaaatatatattttcgaagatttgcttaacatttgactccaggacagaaaatgaaagatgatttcttttacaaaaagtatttttaagccagccacagtggctcacgcctgtaatcccagcactttgggaggccgaggcgggcagatcacttgagcccaggagcttcagaccagactggtcaacatggcaaaacctcgtctctaccgaaaatacaaagattagctgggcgtgatggcacacgcctgtgatctcagctactgaggaggctgaggcacaagaattgcttgaactggggaggcggaagatatccactgcactccagcctgggcgacagagcagaccctgtcaaaaaaaaaaaattataaatatataataggttcagtaaacatacaggattcactctacagaaatcttgcgttgtaatgtgtaatttagattacattataggtaatgtttcattacttcttgatgtctataattataaatcgatatatatacattaaaaaaaggatccattttaactattaatgccctttgttctatttcccccacttatggaatgtctgaaaataaatatatcatcatattttatagctacccactttcagtagatatttttacatatttttagtgcctaagtactcaggtaccatcacccgtgttaccacttggtttcaaaatgcacatgaatttcacctttacaaaattagatgtagttcaaagccaaataaaaacacatttctggaaatgaataattgtatatggatgctatcaagatagtcttggcttatgcgccaataacaaacttcccccaaatctctgttcgcttcatacagcaaaagaagatttctaaatctactctgagtcaggacaatggccacctgctatattctttggccttttgatttcagcatgaggcctcctcaatagttaatcttgaatgaagagtgtattattattattattttgagacagagtattgcccaggctgaagtacagtggtgcgatcttggctcactgcaacctctacctcccgggttcaagagattctcctgtcagcctctggagtagctgagattacaggagcgtgccaccaggcctggctaatttttgtatttttagtagaaacagggtttcaccatgttggccaggctggtctcaaactcctgacctcaggtgatccatccacctcggcctcccaaagtgctgtgattacaggcatgagccactgtgcccagccaagagtgtattattttgctagcattgatgtaaaatatgccacaaactaagtggcataaagcaacagaaatgtatggtctcacagttctggaagccagaggtctaaaatcaaggtgcaggcagagctctctctcgattctcttaggaggaatctgttctatgcttttctctgagcttctagcatcactggtggtgcttgacaatccctatcttgcatctgtgtgaccccagcctctgcctgtgcatcgcttggtgctctctcctggtgtgtcttcgcatcatcttctcataaggaccccagtcacgttggatggagggcccaccctcctccagtgtgacctcattgtcgtctacctaattacatctgcaagaacactattcccaaatgggtcaccttctgaggtactggcgattaggacttcagtatattttgggaggtatacaacccaacttacaacaaaggagaagaaagtaagggggaattgcacagtgacccttcaatgctttggtcaaaaggtggcacaagttgcttctgctcacaatcccttggccagaagcagtcacatggccccacctgactacaagtgagtgaaaacacatcattcccatgtgcccagaaactgacaagtataaagcctaatggtttggattcataacatgtggctgatcttctgggaaatgtcatctgcctctcttactgtgtggctttaaaacatgtctgcaaattctcagacaatcctctcacacaaggtggcgtctaaatgtcttctgaagatggacaagcctttgtgacccacttttattagaatgttgtgaggctcgattagaaacaaagctgctgtggggcacacgtcttggcagccctgagggggcacctaagaggccctgctctcctgaagccaccatgctggaaagaccatgtggcaaggccacagacaaatagagattatggagccccactgatgttagaaagtagctattttaatattcccagagccatcctcccacaggggtgagtgaagaagccctcatataattctagccatcagtcttgaagtcccccagtcacagctgaggcctcatggggctatgctgtgctcagctggaattcctgacccacagaatctgtgagcagaataaatgtcactaagtgttggggcgatttgttgtatttccatggtaatgggcaccatgctatttatatttctctggcaggatcagtatcttgagaagaggggtagatgcagaggcagatgtgtctctcgtcttttccacgtgaaaggaggagtggcatattctggaaagagctgaaagcaagaggcttgcttcctggtattgcttaaaagaatttaaaaactattcagaaagtaaatatattatttttaaatatcccttctgaagatattctagaccttctcttttctttttttcatttccaaaaatctttattcactttttaattgatatttgatagatatacaaactttcagggtacacgtgacaattccatacattcatataatgtataaagatcaaattagtgttattgggctatgcatcaccctaaatatttatcttttctttattctaggaacatttgaattattctcttttagttattttgaaaggtacaatagattactgtaaactgtagtcagcttactaatcttatttcttctaactgtatatatttgtacccattgatcaatctacctgtctcttttgtaaacagcctttattaatagaaaattgtacatataaataaatccactttttcaacatggaaaattgatctcatcttctcatattctgatttcaggagaaatcactcttcttatttatctacttaaaaattttactaagttgtctctttatgcatttatcatttcaaaaaattacaatattaacagtgattgtctcttgatgatagaattaagtgaatttaaaatgttagtcctaaattcgtttattttctgaacattgtataaagaatttagattctttttataatctagtttaaagtgaaaatagcttttgagaaatatgacatgtgatatcaattgattgagaaggaatggaataggcaccacaaggggcttaatgacaccaggaaaagtttagtgttaggaaaagaaaagaaatacttgggaaaagtagagggtccagtccaaacttatgaaaaaccagacagtggtagaaaatgctactgggatttttgtggagttctttgtaagctagaaggaagattctgcttctgatatagaattcaagattgtaaattaaatgtttaggtaaataatataatcggaatagtgttttaggaagatgattgtattcatagtgcttcatttcaaatatagtgaaaaatgggggagaagggaattgataaaataacgcacagttgcttacttcctacttagaagaataaaagatgtttgatgatggacacaagctgatctgagagtcaaggcagctttacagagggtaaagaagaaaactcctataataagtaagtctggctgtactgtgttcttcctgaacaaaagaaccgtgtatttctctgtagactctctagaaataaacaaaggagttagtttctacggattaggtccttcttaaataaagtccccacccaataaactagttttaagaactagtaggggcgggtcaccgtggctcacgcctgtaatcccagcactttggaaggccacggcaggcagatcacaaggtcaggagtttgagaacagcctgaccaacatggtgaaaacccgtctctactaaaaatacaaaaattagctgggtgaggtggtgcgcacctgtagtcccagctacttgggaggctgaggcaggataatcacttgaacccgggaggtggaggttgcagtgagctgaggttgcaccactgcactccagcctgggcaacagaatgagagcaagactccatctcaaaaaaaaaaaaaaaaagttaatatgaaaaagtattactagttctttttttgttgttttttgttttttgagatggagtttcgttctgtagcccaggctggagtgcagtggtgtgatcttggctcactgcaacctccgccttccaggttcaagcgattctcctgcctcagcctcctaagtagctgggactgcaggcactcaccaccacgcccagataatttttttgtatttttagtagaggcagagttacactatgttggctaggatggtctccatctcctgaccttgtgatccgcccaccttggcctcccaaagtgctgggattacaggcatgagccacagcgcccagcctcctattaactttttaactgactattatttttgtgattgtcactttggattaatagtgattaggcaactgaaatatagctctcagcccaacagaagtgttatattgcttgaattcttttattggaaacacattgggcaattcaaaggaatgagcaaagaatcaaatagaagttggaaacaatatccaaacaagaaaacaatttgcattacctcctgacagttagttttaaaccttgtcttactaaaagtgtgactcttcaatctataaactgaccacttccttatttaaaatcaaaagttgaatatttgaattaatcttcatttccaaaagttaaaaaatttccaagagtttagaaaagttttctttaattgaggaataaaactgtagagttctcctcagtaatatacttccaaaatcctttatcctttcagcttttgtttttttctttccaaactccaatgacagaaaacagaaaccagctctgtgcttccaagtttctggaatagttgcagatgagtcaatataaatgccaattttctggtctggtctagagtgaatattttggtgatagttttgataatttttgatacctggtgcttttgaatccagttacaggaaaaatgcagcaatttctcacttttgtttttatggagaaaaaacactcaagcaagtcatgtttttctaagttgttgtggttttttttttttttccagtatcagagaaaaaacaaaaaacatctgttttccttcaagtctttgtgactttccatgtccattcctcagttattaccaactgaatataaagtgggtgatttttctaggatgctttctgaagaacaggaataaataaacttgggaatctgatatttctgaaccataagttctgcattttggattggcaaggaattctcagctcctaacaaaccaaactatgacctaggttaacttgctatttgcatctggtttgcactcacctcatggcatcaagccatctccatgcatgtgatggtggaaacatttgcaagacgtggcagtgacaacaaaggtagcattatgacctcaggggtgtgtgtaagacttggggcttggtctgcagtaggagacaattattctgcaatcttcctggtcctgccattaatttatttaagtcctggaagaatacttaaattggtctcaagttccatcagcaagatgggagtaagtatacatatcaatctcaagggcattatctgaatcatgacaaaaatagatattggttacttaactttacaaatcattagagagaaatataactaatactatagtacactcttctgaaaactaagattgtaatagaattaataggacatttccaggacttataggcattatatttgaaatcaaattttccaaatgtttattttttctctcattcatctcaaattctgccagtaaccatgcattgatataaactaatatagcccaaatgtgtaactaccattatacctaaagttaatctgatatatttatctgctgatggtttattgctctgccttcatttagtgttacagatgcaaagctggacacaatagtggatgcttcataaaggatactgataaaagaaaatatactaagtatctgaggcgatagaggatgaagtgcaacactgtgcttatagcccagctgcagctttatacaggaacggcaggcagggctgaggaatttcttttgagtgcccactgtgtacaacacatagcactagatatcctttaatgtactagctcatttaatcctcataaaaaccctttggaatgtgagttatttgttccttttttccaaatggtagaacttgaggttcattgtgatgaatgaaggtgtgtgtaatcacagcgttggttagaggcagaagtagaagtcagagttctctctgactctaaaacttagacccagctgataggccactttcacttcctaagagctgaaactggccatctaagtaggaaggaatgaaggtcaattcgtggcttttgtttgtagtttttacagtgtggctccattgatgatagcaagttatctgttaggcagaattctaagatgacccgtgaccttcttctgctggatgttcctcttttgatcgtgttatattacgaggcatggagagtttgcagatgttgggattactgatcaattgaccttaaaatagggagataatctcggtgggtttaacctaaacacatgagccttttacaattttctccagctgcttgcggaagagtaagtcagaaataatctaagcatggaaacaattctacgtgagggaaattaatcactgctgatatgaaagctgaaacagatggcttaagggatgagagtggtgctaggggcccctggtcaacctccagcaagacaacaggtactcagccctgcaacagccaggaactcaatgctgcccacaccgtgaatgagttttgaggcagatttttcccaagaacctctagagaagagtccaggccagccaacatcattagttcaaccttgtaaggctttgagcagaatcagctttctggacttctgatctataggaaggtaggctaataaacgtgtgctgttttaagctgctaaatttctataatttgttttgcagcaattgggttactggtcaaattaacattgtttgcacttacacatactagtattgttcttgacacagttcttaattatgagtttggttgcctactggaataattggatcaatgtattacttttctttagtatgagatttcctccactggaagacttgctcttctttatttgagcaggttgatgtgtgccaaatcagaataatgcatttgattctgtcaacttttagttcgttaaagataatttattttaaaagagtatagagtttggtctaaaatgtaatattttctatatgttcaaaaagtggaccatgtttttaataggagatgcaaaggcctacctggtagtggaatgctggctacaaaatgaatatgtctgtgtttgtgaaggaaagaagttattgcagaaaaagtgtcttgtgtactgttaagaattaaaaaggctttgaatccactggaatatctggcaactttgctataaagtcttgttttcattaaaatggtttgggctgaacctttctttgataatttaaaattcctttccactctccctcctcctttctgcctctaactcccatgcttaaagcatcactggtattttggcaaatcaggctaagttaaaaacaaactacttgcttacatattctccagcatctgtctagcagtcacacaagagtgcgctggcgctttcttcctgctgctcttgtgtatgtttcctgttgcccttattacttactggcctaattatccctatccaggagttctatattccatggaaagcctcattgctgaaatggcctagacacgtaaacaatagcatctgtaatgtccgtgtctattcacttctctgtttctttcttttttttttttttttttttttgtttgagatggagtttcgctctgtcacctaggctggagtgcagtggcgccatctcacctcactgcaagctccgcctcccaggttcaggccattctcctgcctcagcctcccgagtagctgggactacaggcgcccgccaccacgcccggctaattttttgtatttttagtagagatggggtttcatcgtgttagccgggatgatctccatctcttgacctcatgatccacccacctcggcctcccaaagtgctgggattacaggtgtaagccaccgcgcccagccacttctctgtttctttagtcgtttcttcctttactcttgtattcttcgatctagccttgttttggttaccagtgttatgtaaccaactattatttacctagtactataaaattgcaacagctgtgttacactcattgattctatgtgttaggaattctggtagggcacagcagagatggcttatgtctgcccataatgtctgtggcctcagctgaaggtgattcaaacatctgagggctggaataacctgaggtcttcttcactcagcagcccgtctggtgccctagtacctgagttgatgtgacccaaaagctggactaagggccaggcatggtgtctcacgcctgtaatcccagcactttgggaggccaaggcaggtgaatcacctgaagtcaggagttcgagaccagcctggccaacatggtgaaacccggtctctactaaaaacataaaaattagcgcatggtggcacgcgcctgtagtcccagctactcaggaggctgaggcaggagactcacttgaacctgggaggtggaggttccagtgagccgagatcacaccactgcactctagcctggctaagctctaaagccattaagaaccctagaacagttacacccaggactgtgtgtacacccagcctgggtgacagagtgaaactccgtctcaaaaaaacagaacaaaaacaaaggctggactcagctggaaatgttgactggaactgggttaggatatttacccactggacaggctgcaggtaggtgttccacagttatggctaggttccaggctagttctgaacccacccagacctgtagctaggttctgtgagaaacataccaaggggcgatgtccaaagagtgagggtctcaaacatcccaaccataaatgcattatgatacttatgatctggtattaaaggtcacatagcagcatttgcacatgtagttgtactctattggttgaaacaactacaagtccacccaggtgcaagagaaggagacataggctacactttttgaggggagagtagcaacgcacattttagagaaatattttgaatgggatctatttggtggccatctttagaaaatgcagcatgccacaatctgccctagggctacaacaatttgtatcccactgacatgcaaaataaaaacaccctctcccaagacccccaaaagtctccattttgactttcattttagactcaaggtccagaatcttatcatctaaattgggtgatatggggctgggtgtgccgactcatgcctgtaatcccagcactttaggaggcccagacaggaggatcacttaagctcaggagtttgaaaccatcctgggcagcttaatgagacctcgtctctgcaaaaaacaaacaaacaaaaaacaaacctaagtgagcgtggcggcatgcctatagtcccaactactcaggaggctgaggtgggaggtcacttgagcctgggaggcctaggctgcagtgagctgtgattgctccaccgtactccagcctgagtgacagagtgagaccccatctcaatcagtcaatcaatcaaatgggtgatatgtaaataagacacctcgagtgcagttcctcaagtatttcttgcaatctgacctgtgaatgtaagagagaggttatctttctccaaaacactgaacatacaatagtcaaaccgatataggataaccactgctattcgaaaatataatcactgtttcatagcaattctgaaatccagcagggaacatgttaccagttccttgataaggcttagacccacaacctgagagttcttctccgcagctcttatattcatcctgggctctttgttccacccgagtcatttttcctttttataaggagtagtccatgtctacagctaagcagatttgtatttgtctgtttctttattttttaaatcatgtatcttgccagtaaaagttttggagttcaaaagccttttttcatttgatactgtctctgtcccttttattcccatctgatataatttctttaaaaatgttgtgggtttgttgtatgtcaatttataagtctaacattttgagagggagtctcactctgtcacccaggctggagtgcagagccaatcttggctcactgcaacctccacttctgggtttgagagattctcctgcctcagcctccgaagtagctgggattacaggtgcccgtcaccaggcccagctaatttttgtatttttagtagagacagggtttcactattttggccaggctggtctcggattcctcacctcaggtgatctgcccacctcggcctcccaaagtgctgggattacaggcatgagccaccacacccaacctggaataacattcttaagacctttagaagccttaatatttttcttaacagagacatgccctgaagatggtttgaaagcttttggtccatctcagtgtgtctacagggcacaaacataaatttttccgaggtctgcataaagggttttgtagtcacatctaaggtttcatcttgattccaagacaatgtttttctgctagctctctggatttaatatttgaatcaatgactctttcttaattgagaagccttttctgtctggaaagactctcctaaacccttgatagttgttcttgaaaaggaagagtttattttttagttaatttctctctgctctcacattctactatagctggctagaagaaaccacaatgcaccttacactcttcttccaaaaacctccttaccttgattaagttcattagcatatttcttattttccgtattactggtggtaactgtgttgacaagctttctaccattatatatacaagtttccttcctctagcttccaataacaatctcctcagtctctttcacactttcactgactccctttttgaggactgtgttacttttctgtggaagctacaacaaagtaccacaagctgggtagtttaaaccaacagaaatttattctctcacagttccagaggacaggtcaaaaatcagtttcattggggaaggtcaagatattggcagggccatgctccctctgaaaattctttttttttttttgagatggaatttcactcatcacccaggctggagtgcaatggcgagatctcggctcactgcaacctccgcctcctgagttcaagcgattctcccgcctcagcctcctgggtagctggaattacagacacccaccaccacacccggctaattttttgtatttttagtagagatggggtttcaccatgttggccaggcggatcttgaactcctgacctcaggtgatccacctgcctcggcctcccaatccctctgaaaaattctagggcagaatctgttcctcacctctcccagcctctggtagctgcatcactccaatctctgcctctgtttttactttgtctttgtctctgggtgcggtcaaatctccctctgcctttgccttataaggacatttgtgattgcacttaaggcccacctggataatccagggaaatctccctatcacagaatactttgatcacacttggaaagaaccttaaaaaagataacattcacagtttcctgggtgatgatgtggacatcttttgaagggcattttttagcctactacaaggctttttggacatctgtctgacacacaatcctaaaaacaaattccacctgttttaggttttgttttggtggtacttcatttctagatccccaattccatttcatttaccatgatggcataaataaagcacctcagaccttgttcaaataattataatcatgttgttttcctcgaagatcttgtggttcaggaattcagacaggattcagtgagatgtcttgtctctgctccgtgatatctggggcctctgctgggcttcattggaatgacagtgacttggaatcatgtggaagcttcctcacccttatgtctggcacctgagctgggatgaatctaaggcggtgctcagcggggaatgtgcaccagagcatccgcatgtggctcttctgtgttgctgagtcctcatagcatggaagcagagtaaccaagggatcctcctgaaagggtgtttggagagccccatgaccccactgggctcaatcagtcacagcccacacagatttgagtggacaggacttgcgatggggcaactgctgtgccacttgccacaccatcttcctccttttttgtttaggtgtttataacatgtgctaagtttcaattcttttttttatcttaaaataaatcatgtctttttaggataaagagaactctttttaggttaagggaaccaagcagaatcagcattcatgatgaacaagcattcacccccatctgtataataaatcaggaaaccaatgtaatgtgcagacagctcctgaattagcaattgtgtctcattgaaggagtccataagaatacagtgtaaatgttttaaggcccaacagccaggtagtgaagagagtgaactctggaggtagctgctctgggttcaattcccaggtatatcacttattagttcttagtttaggaaaatttattcaaccttttagtgcctcactttccacatttctaaaatggagatcacattaccttcctcacccagtgcaatggagactaaattaatatctatatggaaagcacataaagcaatataagaaatagcaatactcattagtttctgtgaaatcaacttttcaattcatctttactactaaatggctaagaatagacacacacacagacaccaccacccttccccccgaaacatgtaaaaatcttgaatcactgcccttgcgaatcaatggctaaggaaaagattggtactgtcatgaatgtttgagagctgagagggtctaaaaggattcggaacacaaaatttaacaaaaatataaaaggcactaaggaaaaagaaacatttttataatacctgaatcacttttctctttttctgccttaataattctccagacagtgaactctttggtgagcctaaataactcctcaagatgcctggaggaaatgtcccacagaagcaggtttttttaaaggacattaattaatggagttgtttagctttatatttttgaataacaatatttaaagagggtctgaatagtatactacatggttaacttctcaatttctgcctgtagaaaatatgttaagagttttcagtagagagcagactctctcaatcgtgaagacataataattatttacccggcttactgtttttcattgcaaatgtaaaggcattctctttttatggactcaaaaatcacttttaaaaaacttgattttgaaaataaatagtaaaaattatgacactggaatattatcgatgagtaggaccgaggaaaaaagggcagagtggaaaatattggaaatggcaaggtctggaatttccaaaagcacgagctgactctaaaccttcagataaaaattttcctctcctcgaacattggcctcacacttttctgggtgtcgttttggactgtcaaggctgagatgaataatttgggattttctcatgacttctgatctgtagcagcttggatttacttagacttcagcaccttcaaaatgacatattagtgtcatctatgttctttcatggagaaataattctgccttcctcaactgtcccctgccactgaatttaatatgtgagcattttgctgtttggaagttttccaacttccccataaagaccagtcgatcaccttgtcgcccttgtaaaggtataactgcctctctcaaagagaaatagttgagatatttgtggctagaggcaacttatttattattattattactgttattatcattatgattgcccagtggcagatgaaaggagttctgtagtatcaacgggtctggcacctttgtttcagctggggtggctttagaagtgggccaagcagtcacctgtgtgagctcccgatttgtaagacctctgtgtctacagatatcctggtttattctcctttgttgacacatttgagcaccgttatagccataattttatttggtggcatgtgattgttgaaatgctctttttgtactttgtacttgcaactgtgtggggctaaagctgaacattgttttctgtgatttataacaacgcgggagaaagattagatctctcacgtaattattcaggatttggcggattcttgagctggattttaagtgattagaagaaaaagggggttttggagcaaaatactccttcatcatcttgattttggaggacttttatactcagggtggttaaaatatgcatgtgaatatggcaatgtagaccttattgctgaggcattggaagcctcctcttatttctctcaagcttttgaagaagagtgttccaaaggacactggacatgctgccttaacccaaaccacacccctcaccctaggctcccctcaccctatgctccccagcacactcacctcactactaaaaatcaattcatgtctattctctgcttcaaaataatatttctccttaacactcagggcaactttgatttcctgagccctcactttgaatttctaccaccatcctagaaataggcatgattcttaacctcatctaagtatgaaaaaaccaggactgagaaagttcaataacctgttattttgtatttagaacacatacgtttaaccactagcttctcattctccaaatctctaaatgggaacaattataactgaaatgttaggattttgaagaattgaagaaaatgtgtgtaaatatctcatgttatgtctaatgtattgtctcacttaatttcaaaaatagctaaaagatcttattgagatgaaaagttcctggattgagtatgattccatatcatttgaaatgcaagaatatatttaccccacatatattacaggttttgaaaagccaataaaattatggttctagtctccttaactcagttactttcagcaggaaatagcctggtttttttccatgaagtggctgtgtgatcccaatacactagtgtcttttactgaacaatattttgcatatattataactttctatttctattttttttttttttttagacagagcctcgctctgtcacccaggctggagtgcagtggcgcgacctcggctcactacaagctccgcctccagggttcacgccattctcctgcctcagcctcccaagtagctgggactacaggcacccaccaccacgcccggctaattttttgtatttttagtagtcatggggtttcaccatgttggccaggatggtctcaatctcctgacctcatgatctgcccaccttggcctcccaaagtgctgggattacaggtgtgagccaccgcactgggccataactttctaagactgaagattcaatagtaaaataaattttttctctgaaatttgactatgcaaatgataatctacagtgacttcttttctgtccgttgctaactcccagctttttgcgtctactgggctaaaaagcgttgtgctctacatgcaatagcgaaagtgcaggcttgggttcttccagggctctgacacagagaaggggtgaggggactctaatctattggctatttaagacactagacagtagcatcttagtttgaggacaaagactgaaaagcagggtaacttgagaatgacctgggatctgatttctgagatctgtggagatctataggaagatctccattggtctcacattattgatctgactctcaaaagccaaagaaggagctgaacaccccagctgagtctcccttgtctcgagtctagggaaagtagaactcccccaggtgtttctgcagaaacaggcaacttcttaatgatcaataatgagacataggaattaaaatcatgatattccaattaatcagtagataaatagcaagaaaagtcaatcacctttgaagcttgaattatttgactggaagatgaggtataaaaatatttcaaagtccagaatgaaaatattatggagatgaacatatgagggaaacgaaaatacctttgggaggatatatttaagaagtcaagcaggtgattaacagaacttctagaagaaaaaaacaaatagcgaaagggcaatacatatacgaataatattgtattgtgtaaccaaattatcctaaaacgaagtggcttaaaacagtatactttttctttatcccatagttttgatgggtcaggaatcccagagagggttagtggaatggttctggctcagggcctcacatgggattgcagtcaaactctcagctgcgtctgcaatctctgaacttgactgttgataacacatccactttcagctaactcatgtggctgctggtagaaggtgaaccatatgaattgttttaaacagaacagcccagagcaggggtgtccccaaagcaagtgatttaagaaagagaatgaaagtgagtgagcaacaatgctcaagatagaagccaaagtcttatacctgaatcttgggagtgacttgccatttcttctactctctgctgcaacacttcagccttggtataacattcgaggggactccacaagagtgggaatactaggaggtggagattattggcaaccatcttagaagctgcctgccacaaatattatagaaggaatatctctagagttgaagaagaacctcaacctgaaatttcagagggcacactcaattccaagttgggtcaataacaaaacatgcacacatattctccataaaggtctccaatgctaaatatcaagtggaaaccagataagcttcaagtttaaactcacctgttacaccaaagtagaaaatgtgcaactggcctgacatatatctctgcaagaatgtaggccagaagacagtgggataatatctataagtgaatgacacatgactgcaactcaacgattatagatcaaaggctgaggggcggtggctcatgcctgtaatcccagcactttgggaggcccaggcgggcggatcacctgaggtcaggagtttgagaccagcctggccaacttggcaaaaccccgtctctattaaaaacacaaaaatttgccaggtgtggtggcgggcacctgtaatcccagctactcaggaggtttaggaaggagaatcgcttgaacccaggaggcggaggttgcagtagtgagtcaagattgcgccactgcactccagcctgggtgacagagcaagactccatcaaattaaaaaaaaaaaaagaattatagatcaagatatcaagctgagctagcatatgcctaaataaaatataaaagagagtttagaatacatatcatgcatttaccccatgagaaaaagaattgagaaaagacattaaccaatcaccgaatagaccattatacagagctcaagacaggggaaaataaaagcagaaaggaaatacatgtaaacattgttgcatggatgagaatatataatgcaaatggtaactaggacttttgaaagggaaggatagaataagctatattttggtaactctcagcccccagatttctgtggctttcaacaataaaagctcacttctcacttgctcatacaaatcctctttacgttgagcaaatctcccaaacagccaacctccatgagtccactcaaatttcaagctgcttaaatgttgtggctgtaccatcttaagacaagcgcttccccttgatccttgattttcctgggagaggaagatggaggttctagaattccacaaaggcttttcactgcctcagcccagaaaaacccaacatgacttcttgtattttattggccaaggactgtttgatggcctcgcctaagtgtaggggagctaggagatgaaatgcaggaaataaaggagaattttacgtatcttagcaaacgtaggggtaggaaatgtgaggtgaaccagggaaagtccactgctaccatgggacatcaataaaagactacgagatgatggagatcaatgtattgcaaagtcgtcatctaattgaggtggataggaggactgtgggtcttactagagaaaatggtttttatcttgtcttcatattatagttgaatctctgtgtgagaggacagaaagtgaaattatcaataaattgagtggacatttgaagtggattttctttatcaaaccgacaaaaataaagagcagggcgtggtggctcatgcctgtaatcccagcacttgggaggccagttggggaggattgcttgagcccaggagttcaagaccagcctgagcaacatagtgaaactccatctccacaaaaaaaattagctgggtgtggtggtgcgagactacagtctcagcttctcagaggactgaggtgggaggattgcttgagcccaggaggtccaagctgcagtgagctgtgattgtgccaccgcactccagcctgggtgacagagtgaaactctgtctcaaaataacaataataaggataataagtaaagaggaaataacagtacaaataaataatatgattgtgtataaaataaatcaattatatgggacattaaactaaatatgaacaaatcagattcttacattagaattcaaaaacatatttgctgttttcaagaaacaagcttaaaacaaatgaatcaaggaagacagaaaataaagaggcaattgcaaactgaattaaaagagtggagctattaataccagaaaatataggcctttggggtgaaagcactgaatagaataaagggtatattgtgtaaaacatttcaattccagtttgatttaaaagtacatcaatctattgggcaaaaatatattcttcataattgacatcagagtaattaacattgtgtgcgtctgaccatgtgcaaaaactggtgctaggtgcttctgtggaaattgtatgtattttggaaatgttcttatactaagcattctggcattctgctctcatgctcttcaactttgtagatggtttggggtgtaatgtttaaaatgcaaagatagatgaatatttgtgaccattattgcaacttatttaatgctgcacatgattaaaaaataccaaatttcttcattttgtcaatcatttgaagtgtcttaaactaactcattggttcaaagtcctataatccaatgtgaagacacttcaatcttccaactaagaatggtatcaccctcttttttcagtagttcaacttcgttatatatttttgtaactagacctaaaattcagttgtgagagtttcatttataattgagtcagactttgtgttacaaatgatagttttgtaataatagttcaggcgatatactgaaaacaggaaacatttaaatgaaacccattcctttagtctgaggcagataacattttctttttagatatcatctcaaaagtgaacgtgttgagtttacttgactatgaagaaaacatttcatagactatgaaattacatggaaatatctggtttgctataaatagaattatgtggcacaggagctcatgaggctctggcgatttaaagttattctgttctcaaaaaaaagtaggtaaacagactgcacatatgaaagaataaagttaggcaggaaataggaggattgccaacctggcaatgtcttcacagggcctgacaggacacaaaattggaaaggtgctgtctaaagtactgaaattctttttagtcacagtcacttgtggacagaaaaagaatctgatttccttggtgataaagaaaaaaactggcggactgaagtaaatatttttaaatagaatgaataacatttgaatattttagtctgtctaaaaaacacaaaacataaattactggatactgatttattagaaattgtatctaaaatcaaactggatagtttgagacttcttcatacaaatggctccatagtatatgagcacactgagtgggtggatgcagctgaagttttctgagaaggttatcatatgaaatgaggacagcaacagggcaaaagtgaaaaaaatgaaatttgagactatttctgcaatgattctttctttcaaatatgtctattgctcataatactatgtgaagaaaaaatacaagaaggctgcaaggtataatgttttaaatgtactctgttacctgcaacttatttgacttctgtttggaaaatattcatggcattgtagcctgaaaagccatttcatgattgaaagaggtcacaggttaaatttgtattcttttattactcttatttattgtaagtagcataggcttttaacagacatcattcagcttttaaccagacacgttattttgaagtttcctagagctgccattggggggttgagatgtgagtgtgggggtgcaggaaatggaaaaaagactacataattaaaagtttcaaagataaatggattgatcttgagcatatcctgagtactacgaagtcatcgtaaggatataaaatgagaaaatacagaaaaccaccagcatgttcacacttacactattagtttattgttctctatttgtgaacagttagcttgatgcttttgtttgtttttgtgtacctaggtgccgtcttcttgaacagtgaaagagtagttttttgaaacatcatagtccacagtttgaatcctctgaataacacatgtgtctgttttagttaccaaaacaatgtatctttcaagcatttatataatattatatataaatatataataacattgtgagttatttacgtgaaatgaatgcatgcatatttattcaatgctctcttcttatttagcgactccattgaaaagaaacataatatatggaaaaattactagaaaatctaggaaaactgactgaatgctttggaaagacacagtcaaggtgagtcaatttttttaaaaaaagctgaacgattaggtacgcacaagtcaagtatcaatgtttgggtcaaacaaaaaataattttttttacagtttgctttgagaaacttgaatttctaatccactttattgaaataaaaacttaaaaacaaaggatcgcaggtattatgtctgtaagaaagccaacacctaactccaaagaacaggtcttattcccacaacagaagcctagtgaatcagtgcacatgtgtatataaaattcaattatatttaaaatatgattatgttatacttaatgatcctcagtttcactttcagattaatgagccaccaacaatgagctctgattacttaatgataagacctttctatttcaatagatttcagtctttatgctgcacaaatagcagaggctaaaaacacttattttgatgtttttaattttgtacaatgaaaattaaacacctcatacattccacacctattgccaagggacatgcacagctggacacagaacctcaattgagattctgttaccactttcattcggggagtgccattctctcccctgcttctaaccttcctcttaccctatgttgtttttgacattaacagaaagattttatatttttatatgaagatcaataaaatgccattagaagagaaagaagttattttatatttttctcagtagaaaacaccttcgccaggattccttacaagttacctggttggtgactaacaagagctggtgtcaattctgtaaccatctttgggggccacttctgtatagagagtaagttgtaaaggccatttccaaattaaggcatgtttatcctcagcatgtggaaaagacaaattgttaagatgtgacttctttcaatatttgtgctacgtaaacatcataatcttaagaagcagtgggacttggagataaaatgccatcagactggctagaagtccctcattcaattctctaaactctgtagtaaaattcttatgaagaccgctaataactctctgctagacagatgacaggtagtatctggaggaatttataaaaaaaaaacaaactctaagactgaaataatcaggtttagaaaaaggctggtgatggatccagtcatttgccttctgaaacaaagcagtcaggcagatctgaataaaacagcaagttgctaggtaattctcccacagtgtgacagttggctagagagatcaccaggggaagttaggcccccttcctcttctgtattggtgctaattttgaggtgattaaactaatattctccccttcacacacctttaggcatcatttggagattgaaattcccagaaaatacaaagtacggaagttgtgggagtgactgatattatgtcttatgagatgaagtccttgtggctattaggacctaagaaaattaggtaaaagaagagaaataaggaacacatgctgtattcaccagaggaaaaaaaatggttaaggctaaaatatcacaatactgatgaaagaatcaaaaaagatgaataaaaatagtatatggcctaggaaggaaccaaaaatacataagaaaataatacataataaaagatacatggaataaacacacacacacacatcccacaggagaaaataattatttgaaaatattggtagagaaattgactaaatgatttgggcaaaacataaatcaaaccatacactgaaataaattcttgtttaaaaagttaaactttgtatatattaccattaagtaaccatttacttgtttaaaataagattttttgagacaaaataattgataatttatatcacagattttctgtcatgcttacattttgtaagtttgttttctcctctggatagtttcacctccttatgctggatatgcgacgactccaggaattttctaatctaagaacgagcgtgttcagtgaaatatcatcggtgttgcaatccgggggagcacgtgaatgtgcctgccaggggagtcaaaagcccttcttgtagaaccgtgaaaggaaataggaagtgaaagctttgccatgtagaacattcctccacactgagagcacagaggatacagacttagttcatatcccagcttcaatcttagagtgccgtgtagatattcctctgtgagtaatgacatttcctcaacatttatataaccctgaaatatcttctgatttctgcctttggtgtataggaagcaacagcacttcttttaaaaggggaaggagggtcagcgcggtggcttatgcctgtaatcccggcactttgggaggccgaggcgggcagatcatgaggtcaagagatggagaccaccctggccaacatggtgaaaccccgtctctactaaaaatacaaaaatcagctgggtgaggtggctcacacctgtagtcccagctactcgggaggctgaggcaggagaatcgtttggacccgggaggcggaggttgcagtgagccgagatagtgccactgaactccagcgacagagcaagactctgtctcaaaaaaacaaacaaacaaaaaaaaaaaacaaaaaaaaaaaaaaagaagaagggagaggggaagtaggtcaatataatgaaagatagcaaagtaaaatagtttgactacataacattttgttttgtacctagaaacaacaaaaactacattctcaagataatagaaaacaaaaaaatgcaaacaagcagaatatcaaaggttaagtagtattaacacttaaaaagctcatacagtttgataaggaaagcaatccaataaaaattgacaaaagccttgaataggtttgtcacagagaaatactttgtcaatgcttgaaagcatgttctacctcactagtgatcaataaaactggaaatgaaaacaattaagatagctttttcactcacaaattggccaagattttttgaagacagtattagtcgagttgcaatgaaacttcagtctttcgtactattgggtataaatggccaccatattttctggagggcaatattgggatttgtatcatgatgcctaaaaaattaatagctttgacccataggttctacaagtaggaactagcttgaggaactagatccatggacaaaaacatataaacaaatacaaattattattatatgaagggtgaaaaattatgttcagctttaatattagtggtcattcaaaattgaaacattgtaaaacaaaaatgtgtacacaaaaaattatgtgctaactgcctgaaacaaatttgtataagtcatatgatccgttttgtatattcattaaaatagtcataaaaatataaacaatgtaataagtatgtttgaatagtattatgatgggctactttaattttctcatatatacattattcattttctagtgtaaacatgaactttttccaaaattattacttttaataagaggtagtagataaaataacagattacaatagctgttgtaaaatgaattatttcatactctgttgtatctgatatcttttatcctgcaaaataaagtttgcttcttaaaatgttgaatttgtgatttttttttctcttttccaccttcttcctcctccccacctgtacctactactaataaaagtgagcacagactgatgctgaaaggaaagatcttatggaatttgactaatcaaatcaatctttctccaaaggagtaaacaaatataggaaaaaatgaaatatgtgattggcttatgatatgtttaatgccaaaatattaactgaaaccttaacatatgcatggacaataaatggggtattgaataaatatttattgatcatcgtttacatgcaaaatctgttgtggttttgatagacactattgcattgaatctttacagcaacattgaccccaatgtggattaaggaactgaggcttagagaggttacatgacctaacagctattgaggagtgtcggcattcaaactgggctctttctcctacaccaaatgaacttcattagcatagtttatttgggtcaatctattctttttcacatatcatgttaacaaaatgacacatgtctaaccaattggaaattatttaaacatagtttaaaatgctactaacacaatatgtattagcatatttttccaaaatcgtaaagttgcttacaattgtggatgcccggtcaccttcagatgttgaatatagtccgccaggttgtggctgccttaccaaaatatataaagatagtgttttatttcaagaccagctcatttcccaaatgtgtacgaagtagtccttatagaggaatattctatggttatagtaaaataaaaatagtacctgaaagctggaacctatggataatatttaaggtgggacttacaatatggaggatagtctatatttttatgaacattatagtacgatcctgttttacttagttgtctactagtatttcaaaattatatatgcacacactctttgtctgaagatatttacagcattatttttaaattactgccacctctcctccaagctctcacaattctacaccttaacctttaacctttttgacaaactatgctttgaatcacattgactgaaccttctgttgttcatcttttaagaaatttacactggatttcagtggatctctataaatttattttcctctgacaagagaaagaataaaaattaaattcaaatataccagaaatgtggtgagaattcccagcatagctattgctgagttagagtatttttttccaacagctgcttaatagttacatataactttataagcaagttatatgttaaggacatggtgttacccctttgttcagtttgaagtacaggaacatttcgcattgcttagtgacattttccagatcatgctgcctttaaaaaatgcagtaacaattccctcatagttaatgtttgaaaagttctgatttaaactgagtttataagatttaagaaaaaagcgttttttattaaaaatgaaaaaaattcctactgaaatgtgagaaattcttaatcaagtagaaatttgaataaaaattcaaattttattttcaaagtttattttcaactttttgttattaatattcaggtacatttaattttttcatattcatttcttttctgtttctttcgtttcaaaaacattttttatgcagtcaaaactgcctctcattcttggaatatttatcttgatctttcacagcaaacttccagtctctgtgtgctgttttacatattaaaggaggaaatgtcaggaatgatatatttgaagcacagtttcatgacctgatgtaacaaaaagtatgattgattccaaaatgcattacaacattgttttatataatcatagtggtggtaaatttagattctaaaatttgatgtttgaccaaataccaatattttctcaagtttcctccctcttagaattttgaggcttaacttctggatgcttagaaattaattaattaatttaattctgcttagaaagagaatttcacatttgaaactacccaagattatagaaattacatagtgagggcttattatgaatcaggcactgttctaacctttaaaataattgtgaattttgtaaccagcaaccaaggaattaattgccctttgaaatcaacaactgtggctgtgattcttggtcccccatagaatcccagtgtggagtgaggccatcagttttatcttctgcttggaaaaccatttatagattgccacagttatcaccagagttccttccagtaatttagttactatattggtaatgaatgaaagcatcaaacaattgtttagaattaaatataagctccttacaatgtggggcatcagactatcaaggcagctatttttaagtccgacttcggagcaaaatccagttcatgcatacagatattttatcatttttacttcaagctcagtaaagccgtttttcaacaagctctctcaggtagagttttcagtataacttgaataattgagctaattgttctctctgcaaatctccagattgtaaaattcttgtttacttttcttttatccccagctctcaacactactcagatactctaactgtcttgggatattttcattggtttcaaaatgtttgattcatattcgactttttcttgctaattaaaatttgggcacaaagatttctaaggactgaattgtgtcccctcccccaaatccatatgttcaagctctaacctctaatgtattttgagataagaccttcagggaggcaactaaggttaaatgagctcataaaggcggggtcctcagccagcagtactggtgtccttgtaagaacaggaacagataccagatctcactctttctctctccatatgtacagagaaaatctatgtgagaacgtagtgagaaggtggccatctggaagccaggaagagaggcttcaccagaaaccagccaggatggcaccctgatcttggacttctagcctccatagctgtgaaaacataaatttctgttgtttaagccaccagcctgtggtattctgttagggaaactctaccaggctctaccagggaaagtgggtttgaaaatgcaaccttctgaaaaacctaggcatatttggatttgcatctatttgcatctggatttgcatcaaacagggaaacctctgtatgaagatgcaaagtccttggtaaaataaattttcataagagaagagagaatcaaggcatatgaatttggtgaaagaattcttaaaagttcaggactgtccataactttatttgtaaaaatgagaggttgacctctacaattactgaaaaccccttctaggtctaaaccaaattcctcgaattatctcagatgcagacaagagactgatgattgtttaagtgaactctgcaaactccaatatccctccattattgaagctctagtttcccggaagcccagggaataagttaccacatgatgtggacaaataagagttctctttcctacatgccctagagggtgagttgtcaagcttgactgcccacccagatactgaggtaggaggtggggctcagacactggaccaaatggaggactagctaaaacaggtccagggaagaagcacctccccctaagacaggcccaccagtgtaccatgtcagcttaccattgctacagcaacacctggaagttagcaccgctttccaccacaatgacctgaaacctcagaagttacgacgctcatcctagaaattcctttataaacttcccctttatttgcacgtaattaaaagtgagtataaatatgactgcagaactgcctcttggctgctattctgggcacactgcctacggggtagccctgctccacaaggagaagtacctctgctgctgcttcaataaaagttgctgtctcacaccactggcttgtccttgaattctttcctagatgaagccaagaaccctccctggctgagccccaattttggggcttgcctgtccttcatcaatatgatagggacaactgagcttgtaaatttctcacacaaagagcaagccagtcatatgtcttgttagaaaaaaaaaatcacaaccaaattctcaggtgatccaaaatttcatgtaaaaacatctgctttaaatctagaaattaggaaattattagtttcttcatgctctctcaaaagcaatacaccattgtatgaataatcatagatgatgtggcattagagtgtccatgtgcacaagtaaagaatgaagttatttcatgccaaatacctttcactgttttatttcagacttttaccactgaaattttcaaacaaccatcacggtatttatctcatttacttaataaataccacaatccaattcaaatactgctgaagagataatataattttgtctttaccattcttgttcacaaattgcagaaatttctctgtgcatttcaagacgtgaccacaccttccctatccctgtcccaacaggtcatgagacccccctcatgttttcttaaaattttagtgttcctgctttttctcttttgttttcctttctcacccttccttattttgttccatatttttccttcctactttctccttttcttcatttcctttcttccttcgtttttccctcccttttgttagcaagtccaagtgcttgtctgtggccctttacttactgcgtgctctatgaggagaatgagcttcaaaggtatcatcacaattaagaagtgcagtattaaaatgggtatcattctgtcaatccaaagcctgggaaagaaaggaaggaagctgagaatgtttgaacttaagattccaaaatcttatctgattcctggtattgtttttcctgtgatagctattattgagcagcagttgccaaaaatattgtggagtggaaacattagagtatgagtgtaaagaaagaaataataaagggttaaatcatattgtttaagatgagaaggtgatatagaaaaaaaaaaactagtgctttgaaaaaaacctgtatagaaaggaaatatgaagtgtgaataacagggagaagccatttgttacatatttaggaagggctctgtgaaatctggatggcgtgtgtttagcgacgtcactaatatcaaagaaaaggagtccttttaaaattgaatggacagagttacattttttataggtgtaatcatatttccaataaagaaattcaatggaccaggcatggtagctcatgcctgtaatcccagcactttgggaacccaaggctggcgaatcacttgaggtcaggaccactcgagaccagcctggccaacacggtgaaacttcatctctactaaaaatacaaaaatcagctgggcatggtgacgagtgcctgtaatcccagctactcggaggctgaggcaggagactcacttgaaccctggaagtggaggttcagtgagctgagatcataccactgcactacagccttggtgatagagtgagattctgtcttaaaaaaaaaattactgaacagagctatataaactatatacatttgaatataagaaaatgaattttcaaaaaggctaagaggatgcacagctgccttaaaataatgaaaaaaattccacatgactttaatggcacattaaaaatattgctataaagtccaatggtgttgaatattcctgaaaacttttttctctttttaaaagtattcagaaattttctttgtaaaattaagtattttggtttgagacattttcaattctttcttagctggaaattcattactcagtgaatttttaaaaagtttttaacagtgtttcaccatcatttctatccaatcaaaacagttattgctggtagtgtggacagtcatcgtcatgtttcatcaagtctgatatataatcagtcctggtgggtgagtctatgggtagtattcaacattttgacctctgtacttacaattatatagatgtcaaatcccagaaacaaaggtccaatccctaatgaaatcctatcatcagaatgccatatggtaacaacattagaaattgatttttgcttcaaaggccttgcctggactgaatacagtatatgtgcatctgattgagctttggaaggcatgcacgagaagtcttaatttttccttccttatgaaagtttcatggtttaatttttttcaagatgtttgaaaataaatttttcaaagtctttatccatatcacctttgatatgaagaaatcaggaagaatgatgctttgagctatggaaatgtgttaggatttaagaagtagaattagaattatagtataaggctgatatgtttttcatttataatttttttacatgcaacatttttaaaagataaatatttcctcttaatggggtcagtaatctcaagaatgctgtgtccctggagttcttaaaatgttctggttttgctttccccttgtacatagtttagaacaaactttgtaacttcagagccaggatttcatacacaattttaatccaactctttccttcacagattaacatgctgagactcgggaggtggtgatttgcctagggacacagaaaagtaaggattaaaaacttagtttaggattcccaatccagagctccttctattacagtatgcttctttagacaacgagttgttagttatgtaatgaaaagaacatatgaaactggctcacacttccataagctagcagatagttattccccactttaaaaatatccatatagggcagggcgcggtggctcacacctgtaatcccagcactttgggaggccgaggtgggcggatcatgaggtcaggagatcgagaccatcctggctaacacggtgaaaccccgtctccactaaaaatacaaaaaattagccgggcatggtggcaggcacctgtagtcccaggtacttgggaggctgaggcaggagaatggcgtgaacctgggaggcagagcttgcagtgagccgagatcgcaccactgtactccagcctgggctacagagcgagactccttcttaaaaaaaaaaaaaaaatccatatataccaataattcaaacatacgaacagataaattagtaattctttcataattaattactttatgacacgatatgtgtcactgacttccttaaattgttgtttgggtgtacgatagacacttttatttggatttattcaggactttctagaattcatctagaaaaaatcagacacattcctgctctttcttctgtagcagagtgaaatactatttttatgctattctcatttttaatttaaaaggtaaagtccctaaaaaatatcctttggaaaacctgctaatgaaagctcagatcttggggacagcatagcaatgtagaagagtgtgggccgagagacctgtgtattctcttagccccagcacttcctagacagataaacatgggagcttcagtatgtaggtaaggagtttcataagctttgccgtattcatacagcaaatgtatgaaacaattgctgtaatatgaactctctcacctgttgtgtctgtttcttctctctcatccactgagtaaaattccttcataagcggggtatcccttgagaaagcctagtgcctagagataagttcatgaccctttctcttttctttaaagtgcattctaggtacgtcagtgaattcagtcttatatttgccactcaaacttgttttgagtggtgtgaatacaaagaacaaaggttatttttagaaattctaataatggaatctgtttcagccaagcagttagtaaatgtcaaaagctttcccccaaaaaatctggacgctaactcttacacaactgctcaccaaaacaatttttccttgagtcttttaaaaggagtatgtgctattaggtttctggacataaaattctgtttataaactttctaagatttggaatatactaactgctttaagataataactgctgcgagcttccagagttttcttaactttatcacttaggttgactgaattggcatctcaggactttcctgcaaagtttatgaacattctcactgtagtttttagcttttttgctgcatcatatttgttaatctaattaattgtttagctttatctttagtccattttcttcactggctacacaacatctcactcattataatgtgttgaagagggatttttatggtccacataaaattgtttgcaagtatcttcggcaatatattatctttgtttacgatactctcacttttggtcaaaattattacatctccagggacaagattaaatagtttttctggcatgattcaggctttagtttttgatttcgtgttttcattctttggtttaccccaaaaaactaatgtttagcacacggtttagtttgttttcaaacctgataacgtatgacagtcattgtatcaggttctactattctttacatggcctcagggtgcttactgaaacttagaatatattttactcctaatttagcttaaaaattaatgaatatatcaaatgtaaaaatgattggccagatcaacagtaacagattatgtaatgtttatttatattccttttggctcaaataagatgaaaaaatgaatcttagctgaatttcaaagatgatgagcattttatacactagggattgtgattccctataagatgaaaagaggttattttgatctcaattttcgttttgtaatcacccattgtcaaatttacttttcaaagtttttttttttaactattcttaagtttgaaaactttctagaccttagccagtatgtagaatgcccaatgcatatgttgactgctgacaagcttcagagccattgttactaaaaaatagaaaaatagtctataattcgtaaatgagagtgttttggaagactgctttccttttccaggacataaacaactttacttcatgaactagatgataatgctgtacagagcacacagctggaattcagtaaccattgcactaaaaccattttttaaagttagtattgaaaacaggatattttcagggcactgacttcctaattaaacagtttgaaagaaaacattattttgtagcaaaatatatagatactgatattttgtatcatactgatttgtcacctataccagttaaaaatgttttagtgggcttctgtagtcccagctactcgagaggctgaggcgggacaatggcttgaacccagaaggcagagcttgcagtgagccgagatcgcaccactgcactccagcctgggcaacagagcgagattccgtttcaaaaaaacaaaaatgttttagttaaattaatgtgctacctttacatgcttatgaggaatattttctcttttcaggactaattatttttatacagtagttatgatgtaccagtatataattctctgtcaacgaacaaaccacttatttggttttatttatgcaggcaaaatctttgttttagtaaaaggtattttaggctgggcacggtggttcatgcctgtaatcccagcactttgaggccgacgtctgtggatcacttgaggtcaggagttcgtgatcagactggccaacatggtgaaaccccatctgcactaaaaatacaaaaattagccaggtgtgccggcacgtgcctataatcccagctactcaggaggctgaggcaggagaatcacttgaatccgggaggcagaggttaggggcagtgagctgagatcacgccactgcactccagcctgggcaacagagcaacactatctgaagaaaaaaaaaaaaaaagataaaggtattttagtgtaatgcctttttgaaaatgaaacaagcacttcaattgtgtggctgaaatgtttccttttaaacatgcatgagtatttaaatattatttttagtttttttttaaaatgtattggataggagcacttccactcacaaaaagtattttagctggccagaaaaagtcaaatatttggaaaagattatttttgagaaaatatttaaagccattttaatatatactgcaggattttctaccaacgtaagattctgaatgttctcagagcactgaatgacttttaatcacaatgctaagtagtctatcttacaagatgtttcatattgattcacttggtcataaattcaaaagtatcatgtactaaaatgtttataatcattaaacatataagagatgaagcaatagcattctgttgtcctctgacactctctttcacaggatcatactttttatcatagtaatacatatgtgacatctggttagagaacaaaaaagggcagagaaagatcagtgtcttcatgatagtagttttcgttcatcatgtaagatgataatggactgaacttagcagcttataatacaattttcattttattttaaacatattttgcatgatataaaaatattgatcacagtgagttttaccaattgttgttgctataaaaatgaatgcagaaacaatatttttagtggaaataaattatatagtcattcttttaaagaaatcacaagaggaaaatcttggctgtttggtcattggcagaaaaccagtctttacaagaggccttttgcagatgagctccagtccatttctgtaaagttatccacatggttcaggaaagacagacttttgtctttgttagcatggacccacaagggtctctctgttcacagacagttctactgtggcaacacagttttccataatagaaaatcgatgaactggaaaacagtacaatcttagctcatcatttgtggtcttttccaatatgaagggacacaacgacacacttcttcactatatgaaaatcctggctcacaagccttctggcggttcgtacatggccgtctgtaacagctaggagaacaaacaagaacacacttacgttaaagatcaaggcaatggattcatcatgctaccaaggtatttctgtgtttttaaatttcagactggaataaaattactaattttatgacgaaattgttcataggtttaaaaaagtttgtttctgcttagaattacaacatttaagaggaatggaaaagccttaaaataaaagtcttgcttgctgatataacaaatggaaggatgaggtattgtaagcattagttcctttgaagtgctctttgcttcatgggtgaaagaaacataaaacagaaattctgaaagtgaacactgaaggtctgctgacttactgtgatcacataagcatggcagaattcacatgagtctgggacttgtatgggacccagacttccaggcaattaaacccagccatgttggcagaactgtggtcctcagtgagcagccccaccctcactcttgtgtctctacttggcagctggctgcatgacggtgactaactcttcctttccaccttggctccaggtgaaacagaggcattctggggcagggaggtgagaaggacaatactcagcagcgagggtccccttcctcccatcctagacttccagtttccagtagcggtgagaggacaaattatcaattggtcagtgtgtctcctgccctgttgctccagtgaattgaggcttcattttttgagacagagtcttgttctgtcgcccaggctggagcgcagtggggcaatctcagcttactgcaacctccgcctcctgggctcaagccattcttgtgtctcagcctcccgagtagctgggattacaggtatgtgtggccacgcctggctaagtttctgtatttttcatagagccagggttttgccatgttggctgggctggtcttgaactcctggcctcaagtgatctgcccgccttggccttccaaagtgctaggattacaggtgtgagccaccacgcctggtgagaattggagctatcttttaaaaacattttggagtatgagcatgcctaatgtgtgggaataggtgtaaagggaaaagtgcaagatgacctgaggtggaaatcaaaagtgtgctataaaaaaccctacacaatttggttttgacatttcatttatttggctctagaaaagaaagcatgtctagttaatttttcttaaactttgcaaatgcaaattcatagttatgactactggtattcctctactaaaaagggatatgatacttaatgatccataaaagctgttaattaaggcaatgaaccaaagaatatatactctgcctactgcactttgtaatagatattaagagagaatgaggagaatatatattttcaaaatatgatattttctcttttgctccaatttatatcacaaagcttggaattatacacttagaaaaatgaatctaggatgagttgcagtaaacagagtctttttgaaagaatgtatagtattaggagaaatgcaatgatagaaatattgtctgtgttcatataattctgtagaaaagtaggtatgcagacataagaatttcagatttttcaatgtatactaaattcactcaataagaattcaatataaaacatagtttaataaggcttaaaaagatttagtatctatatccttctgaaaatagtagcatatacatttttgaaatgtcctcttggttattacagtaggaatatataggtaaaattggaatatagttctttctcaaaataaaattatacctatgatgtactttgcagtataagggaagaaaaatataatcaatgagatagccagatccactaaagcctttttatccagtagctaaaatattagtttaggaaaaccaccaaaaatatacattaaaataaggacacaaaactcttgagaataaaaagatgaactcgttatatactgtggaaaaataataatgaacattagtgaagatagtaaataaatgaaatacaagcttttttctgttaaaaagaacattatctacccatatgtaaagaatggatgtaaaaagagaatccagtgaaagtgattaaaaacaaatggtctgaaaattaagtagacaactaggaaagtacaatgtcatgtcatagaagaggtgagcttaaagaaaaaggccatggaaaggacaggttacctaaggacaaaattctctgttggatttggcaactatgaggccaatgaaacgttaaacagaggtttaacatagcactgtaggccataaaccaggttttagttggttgaatacatggtaggtgaaagaggtgaaaacaaatgcctcgtttttgagcagctttgaagagaacagacctgggttgctaaagtttgctcaacttcacagtaagaggctaataaaatagaagaaatttgggaacttttataaactaaggggaaaaaaagtagagttgaagatgttcaagttacagaagaaagaaggaatggcatgaagcaatgttgaaggaatgtggagaaaatgtcaaacggacaggtctggcttaaatagtaggatcaatttattctctgagattaaagaggaagaggtttcgggattaacactgaatgtgcttgagtcgaataacttcattttttttttcttgatgcagaagagtcaaaaccaagtttaagacatgagtcttgggtacctttaacaacatattcatttatttctctaattctatcaaatacttagctatgtattttcatttccagatataattctataccagtggtactctcctgtcctttgtttgtaagttttgcataaaaattgtctgcatttagaacagttgtcctaaattatgtctgaaggcatcctactttttggtgggggtgaagtggattgcctttaggtattttgaaaacatcccacaggaaccactaatttagagtatattctgagcttggatctaattttgatcctcaaggctcctgtcttgcttttttggaagcaaatccagtctcatgcaagtttagcattggttaaaaaaatataagatttttgtctttcagaatgtattggcctcattctaacaagcaattgttactttggttaagaaaactgcttttggtttagagcatatttctagtaagataaattaatattcttcatgaggatctcttacctgcatgtttggtggtggaacttctttccttttaacaagcatttctgtggactttctgtacattcacaggcacattttccaggatttaggggttgatttctggggcaggttcttttacatacacactggcatgtgttttcatcaaattctcggttggccccacattggctggggaagagtttgtttttacagacacactggcatgagtttctgtctagttctttgtggggtccacagctggcaggccgaagccccgctctgcagacacactgacaggtctcttcatccagctccttgtttggtccacagatgtcatggaatccatctgttgagtctagacaaatagtcagagaatctttactataccttacttggttctgggtgtggcatgaaacaaaagcttttaaaagcatcttccttttgtatgttttccatcaaaggattgggtacaaacatgagtatgttcctttataaaggagttcaaaataataccaacgtgaagtagaaaatgtactattttttagtcacttatttagaagaatgatgaatattatatgtgtggttttaatattagagtatgttaatcacaatatagacccctggcgtttagtctttaaagcatcattctgcttaccatctccagcatccgaggaaaacataaaatcttcctgagccaggcatctgcagatgtgattattccacatgtaattggtggggcaggtcttgttcgctgcctgacacctttggaagaaacagacgaggtttagcaatggtgtaactggtacctagaagggaccatctctgctcacatatgtatcaaaataatgctcatagaaaagctttaaaaatataagaattatgagataaaatgtgaatgttttctcccaaactctctctacccacaactgctataaaattccaatcccagaggtgatcactgtttgtggtatggtcttagaggacaccagacttttatctttttaaggcaaacacattggtttgtataatcatatagggttttagcttgtgaaataaataaggtaaaaccttttgctttaaaatttttttccattatacaatatatcatggacatttttatatgtcattgagtagagttctgctccattatttttagtggctatgtaatattccatacaaaagatgtaccattatttattttattcatctcttaggtaactatctacatcactttgattttggcttttccaagcaatactggaggaaacatctatgtaaatgtatctttactgacttatttctgaagcacagatccccatcttgtaaagcctccagaaatgcaaaatttccactctgtactcccccaaaaagttatcaaagatattttgtttcattgttgttctagctctttacttccttccttccctccctccctcctttcttccttcccttcccctcctttcccctttcttcccaccttccttccttgttttagagtaaaaattatgaacctacaggcttcagtcaagtaccctaattgctcctttgatggtccaatggccccactgttgctacctgagacccctctctgttggtgcccacgtgacatgagccctctctggggtgaacatatatcacaagctcagcttgctcattttctcctccacacctggcatcagccatttcttcaggagccctaattctctttgttggaaaacagcattttagaggctatcatttgagatcagaagtgtttagtgccatcagatcacattactactagaccttttcagggggcagagctagaaaaatgcattatatcctgtagaatgttttcctagttaatatttacccagtagaaggatttttggttttaaatatgctaatttacaggatatatatcaacttctcactacctcattttttcatctaatgttggtgtagacatcaaatagaagtatttatttatatctttcacactcattatatattgtaaacaactttatgtgctggaagaatgttgagttacattccaaattgatagaacatagtaagaatcctatgtagccatcttaacatgtgcattgagtataaacaaacaggccagttactaagaaagttttgcagacatactcagtgtgacaatacatctttcttttaataatagcctggtaactcttacagcatcacatagaggaatttttcaacagaaaaacaagcaaatctgcattttgcaaccaaaatgcagcttgaacatcttccttcagcttgaacatcatttctgaagatttaccaaagctttcctgtccagcaagtctctacagcatctactagacacagacatggggaaggtctcttcattcctcttcatatgacagtttgtcgaagattgcccccttgtcctccatccacccatcaccttctgcaaatagcaatgactgatttgacctttctttgtcccttcttgagtttcttcaagagtcatttctcctttagcaaggtgaaaaacagtctattatgggtcttttatttattttaattttgacttttaactttttgattgctgtgttatttgctatgctataccacaaagtgacaatttctcatacagcatatacacggtccatgtaactagatacaaagcaactgtatgttagcaacatcaataattgctgattaggaaacaatatacattttagattttatcaagagagtttgtcacttttctatgcttttctacaggcattattaggtatcaattattttgtaggaaatagctatgttttggtttaccttccattcactataattgttcccatttagaacagaaatgtgctctcaaaatctatttttgggaatagattactgatcttaagcaagagattcctgcacacatttttagagaaaaaatttcatactgttacttccaaatccaattaacattactggattttaatgtactactttgacttcatactaataacttccatgaaaaccttggcttctaacaatcttcacataaactgttatttgctttatcctgcatatattatgtacttctatgttcttacttttgagaatgtcaaacatgtatgtaattatcagagttaagactatgagaaaaatgtacagtcagagaagttctgtatcatcagcaagtttctttttttttttttggctttttggtttatgttttcagggtatcttcttgccaaaaaattgcatatatgttttttcacattttgttacacagatagcatccgttacacattattgtaaaccttgtttttttcacttaccaatatttcttggagaacattgtaccttcctaataattttaggaattccaagggcaagtctctactcattgcgcatttttgtcattattttctaggttaatcatgaacatatattgttctagataaaatgcagacagtcaggacttatccaaaacagtatcattgtttttaaaatttatatcctcttgatagttagcatccttccatcaaatatgatacaacttatattaagttctataatagcaatgcaattaatcctggctgcatgaaactcataatcttctataaatgatggtaaaaacattttggttatgtcgcttctgtgttgattgatatatggtttaagtaacacactgccatgttggcatcgagtggccattataacgtgttggtagaaaggcatctttcattttaccaacatgtgatttatactgccattacctaagccagtgttattccagctgctgcttgcaacccattaatgaatcatgaaatcaatgacatgggctcagaaatgcattttaaaatgtaatagaatgatatgtaataaaatacaaaccaatagaatgcatgtgatacagattggttcctaaagaaagcaccgtgcttcaaaagtgaggagcaagttcttcgcatttaaaacttctcaggcaaaaatggtgggcagggggtcaacatttccaaaatatttttattttagaatgaaaggaaatgtggtcatgatggatagaggtttagtaaaatttggttatctcctttacgttttaatctccaaagcatttctccttacagaaatttctcttctagttctgaatattaaagtatgcataaatactttaaaggtttataattatgttttttgtatagtgtatttataaaagacattgattcaaagacattctgtctgcaaagcaaagcagggaattgcacaattatttgcaaggtatgtctatgttgagaatcatgtgaataaactaactttcctatccccccaccgaccccaccacacacacacacaggcacaaccacaatcctgcctataacctgtatgaaggataaagatgcttttatcagaattgtttcattaattattttcacagcttcacttgactttggtgtggcagctattgctttatgctggttaaaatcacgtgacaaaaatatgagtatatgtgtttttcaaactaaagaacaatgaatttaatgataaataaaatcttagtttgcatttatctctcctttgaaatattaaaagataaatgtattccaaatacgttctgttacattatattctaaacgttgggtaataattaccagctcttggggaggagccaagatggccaaataggaacagctccggtctacagctcccagcctgagcaacgcagaagacgggtgatttctgcatttccatctgaggtaccgggttcatctcactagggagtgccagacagtgggcgcaggtcagtgggtgcacgcaccgtgcgcgagccgaagcagggcgaggcattgcctcacttgggaagcacaagtggtcagggagttccctttcctagtcaaagaaaggggtgaggggcagcacctggaaaatcgggtcactcccacccgaatactgcgcttttccgacgggcttaaaaaacggcgcaccggcccggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccggcaggcggagcttgcagtgagccgagatcccgccactgcactccagcctgggcgacagagcgagactccgtctcaaaaacaaacaaacaaacaaacaaaaaaaaaacaaaaaacggcacaccacgagattatacccgcacctggctcgagggtcctacgcccacggagtctcgctgattgctagcacagcagtctgagatcaaactgcaaggcggcaatgaggctgggggagggacgcccgccattgcccaggcttgattaggtaaacaaagcagccgggaagctcgaactgggtggagcccaccacagctcaaggaggcctgcctgcctctgtaggctccacctctgggggcagggcacagacaaacaaaaagacagaagtaacttctgcagacttaaatgtccctgtctgacagctttgaagagagcagtggttctcccagcacgcagctggagatctgagaacgggcagactgcttcctcaagtgggtccctgacccctgacccccgagcagcctaactgggaggcaccccccagcaggggcacactgacacctcacacagcagggtattccaacagacctgcagctgagggtcctgtctgttagaaggaaaactaacaaacagaaaggacatccacaccgaaaacccatctgtacatcaccatcatcaaagaccaaaagtcgataaaaccacaaagatggggaaaaaacagaacagaaaaactggaaagtctaaaaagcagagtgcctctcctcctccaaagaaacacagttccttaccagcaatggaacaaagctggatggagaataactttgacgagctgcgagaagaaggcttcagacgatcaaattactctgagctacaggaggacattcaaaccaaaggcaaagaagttgaaaactttgaaaaaaatttagaagaatgtataactagaataaccaatacagagaagtgcttaaaggagctgatggagctgaaaaccaaggctcgagaactacgtgaagaatgcagaagcctcaggagccgatgcaatcaactggaagaaagagtatcagcaatggaagatgaaatgaatgaaatgaagcgagaagggaagtttagagaaaaaagaataaaaagaaatgagcaaagcctccaagaaatatgggactatgtgaaaagaccaaatctatgtctgattggtgtacctgaaagtgatggggagaatggaaccaagttggaaaacactctgcaggatattatccaggagaacttccccaatctagcaaggcaggccaacgttcagattcaggaaatacagagaatgccacaaagatactcctcgagaagagcaactccaagacacataactgtcagattcaccaaagttgaaatgaaggaaaaaatgttaagggcagccagagagaaaggtctggttaccctcaaagggaagcccatcagactaacagaggatctctcggcagaaaccctacaagccagaagagagtgggggccaatattcaacattcttaaagaaaagaattttcaacccagaatttcatatccagccaaaataagcttcatataagtgaaggagaaataaaatactttacagacaagcaaatgctgagagattttgtcaccaccaggcctgccctaaaagagctcctgaaggaagcgctaaatatggaaaggaacaactggtaccagccgctgcaaaatcatgccaaaatgtaaagaccatcgagactaggaagaaactgcatcaactaatgagcaaaataaccagctaacatcataatgacaggatcaaattcacacataacaatattaactttaaatgtcaatggactaaatgctccaattaaaagacacagactggcaaattggataaagagtcaagacccatcagtgtgctgtattcaggaaacccatctcacgtgcagagacacacataggctcaaaataaaaggatggaggaagatctaccaagcaaatggaaaacaaaaaaaggcaggggttgtaatcctagtctctgataaaacagactttaaaccaacaaagatcaaaagagacaaaaaaggccattacataatcgtaaagggatcaattcaacaagaagagctaactatcctaaatatatatgcacccaatacaggagcaccaagattcataaagcaagtcctgagtgacctacaaagagacttagactcccacacattaataatgggagactttaacacccactgtcaacattagacagatcaacgagacagaaagtcaacaaggatacgcaggaattgaactcagttctgcaccaagcggacctaatagacatctacagaactctccaccccaaatcaatggaatatatatttttttcagcaccacaccacacctattccaaaattgaccacatacttggaagtaaagctctcctcagcaaatgtaaaagaacagaaattataacaaactatctctcagaccacagtgcaatcaaactagaactcaggattaagaatctcactcaaaactgctcaactacatggaaactgaacaacctgctcctgaatgactactgggtacgtaacgaaatgaaggcagaaataaagatgttctttgaaaccaacgagaacaaagacacaacataccagaatctctgggacgcattcaaagcagtgtgtagagggaaatttatagcactaaatgcccacaagagaaagcaggaaagatccaaaattgacaccctaacatcacaattaaaagaactagaaaagcaagagcaaacacattcaaaagctagcagaaggcaagaaataactaaaatcagagcagaactgaaggaaatagagacacaaaaaacccttcaaaaattaatgaatccaggagctggttttttgaagggatcaacaaaattgatagactgctagcaagactaataaagaaaaaaagagagaagaatcaaatagacgcaataaaaaatgataaaggggatatcaccaccgatcccacagaaatacaaactaccatcagagaatactacaaacacctctatgcaaataaactagaaaatctagaagaaatgaataaattcctcgacacatacactctcccaagactaaaccaggaagaagttgaatctctgaatagaccaataacaggatctgaaattgtggcaataatcaatagcttaccaaccaaaaagagtccaggaccagacggattcacagcccaattctaccagaggtacaaggaggaactggtaccattccttctgaaactattccaatcaatagaaaaagagggaatcctccctaactcattttatgaggccagcatcattctgatatgaaagccaggcagagacacaacaaaaaaagagaattttagaccaatatccttgatgaacattgatgcaaaaatcctcaataaaatactggcaaaacgaatccagcagcacatcaaaaagcttatccaccatgatcaagcgggcttcatccctgggatgcaagactggttcaatatatgcaaatcaataaataaatgtaatccagcatataaacagagccaaagacaaaaaccacatgattatctcaatagatgcagaaaaagcctttgacaaaattcaacaacccttcatgctaaaaactctcaataaattaggtattgatgggacatatttcaaaataataagagctatctatgacaaacccacagccaatatcatactgaatgggcaaaaactggaagcattccctttgaaaactggcacaagacagggatgccctctctcaccactactattcaacatagtgttggaagttctggccagggcaattaggcaggagaaggaaataaagggtattcaattaggaaaagaggaagtcaaattgtccctgtttgcagacaacatgattgtatatctagaaaaccccattgtctcagccaaaaatctccttaagctgataagcaacttcagcaaagtctccagatacaaaatcaatgtacaaaaatcacaagcactcttatacaccaacaacagacaaacagagagccaaatcatgagtgaactcccattcacaattgcttcaaagagaataaaatacctaggaatccaacttacaagggatgtgaaggacctcttcaaggagaactacaaaccactgctcaaggaaataaaagaggatacaaacaaatggaagaacattccatgctcatgggtaggaagaatcaatatcgtgaaaatggccatactgcccaaggtaatttacagattcaatgccatccccatcaagctaccaatgactttcttcacagaactggaaaaaactactttaaagttcatatggaaccaaaaaagagcctgcatcaccaagtcaaccctaagccaaaagaacaaagctggaggcatcaccctacctgacttcaaactataccacaaggctacagtaaccaaaacagcatggtactggttcaaaacagagatatagatcaatggaacagaacagagccctcagaaataacgccgcatatctacaacaatctgatctttgacaaacctgagaaaaacaagcaatggggaaaggatgccctatttaataaatggtgctgggaaaactggctagccatatgtagaaagctgaaactggatcccttccttacaccttatacaaaaatcagttcaagatggattaaagacttaaacgttagacctaaaaccataaaaaccctagaagaaaacctaggcattaccattcaggacataggcatgggcaaggacttcacgtctaaaacaccaaaagcaatggcaacaaaagacaaaattgataaatgggatctaattaaactaaagagcttctgcacagcaaaagaaactaccatcagagtgaacaggcaacctacaaaatgggagaaaattttcacaacctactcatctgacaaagggctaatatccagaatctacaatgaactcaaacaaatttacaagaaaaaaacaaacaaccccatcaaaaagtgggcgaaggacatgaacagacacttctcaaaagaagacatttatgcagccaaaaaacacatgaaaaaatgctcaccatcactggtcatcagagaaatgcaaatcaaaactacaatgagataccatctcacaccacgtagaatggcaatcattcaaaagtcaggaaacaacaggtgctggagaggatgtggagaaataggaacacttttacactgttggtgggactgtaaactagttcaaccattgtggaagtcagtgtggcgattcctcagggatctagaactggaaataccatttgacccagccatcccattactgggtatatacccaaagaactataaatcatgctgctataaagacacatgcacacgtatgtttattgcggcattattcacgatagcaaagacttggaaccaacccaaatgtccaacaatgatagactggattaagaaaatgtggcacatatacaccatggaatactatgcagccataaaaaatgatgagttcatgtcctttgtagggacatggatgaaattggaagtcatcattctcagtaaactatcacaagaacaaaaaaccaaacaccgcatattctcactcataggtgggaattgaacaatgagatcacatggacacaggaaggggaacatcacactctggggactgttgtggggtggagggagggggagggatagcattgggagatatacctaatggtagatgacaagttagtgggtgcagcacaccagcatggcacatgtatacatatgtaactaacctgcacaatgtgcacatgtaccctaaaacttaaagtataataataaaaataaaaataataataataataataattactagctcttatactttcaacatcacagcaggctattttgtgcatgctatttttgtgattctcatattctacactctttgccacggaggttttcctacacttggagatttcttgactcctcaaatccacatttaaggaactaaaacatgctatcaccttttgtttggtcttagtcagaactgggctgaaatgttattctttttcaaagagctataatctgctataatctcttatacatttgtatatacatatacatatatataatattcatgcatttttccagctttattgaagtatgattgataaatattgtacatatataaggtatacaaagtgatgttttggtatatgtatacactgtgaaatgattaccaaaatcaagctaattaacatatccacacctcaaagagttactgtgtgtgtgggggagttggggggtgcagtgagaatactattgagtagagtaactatgctgtactatacgttaggtctccagagcatattcaccttgtaactgcaagttgtcacactctaacatttccccatgtcccccacccccaagaccgtggtgaccactcttctattctgtatctatgaattctacttttctagattccatatataagggagatcagtaatatgcatctttctgtgtctggcttatttcactcagcacaatttcctccaggttatttcacgttgttggaaatgacagaatctttgtaatatatttctaattgaaaaaaattaactgcaccttgatttatgttaaactacttattgatttacttccccagatctctcttaaaatacttcacagatcattcaaaatgaatgataacattaatgtcaattcaactgtagcacatgatgattttcttgaaaagcaaattatttctatagatacgaactgtgttattaatcaagtactctcattggaagctcttttaataaggtttttcacaacaacacaacaaataaaaatttggcttaccatgtggcacctatggttccatagctgtgtccctcaaatagccttcctatctctagtcttgttcaatgggaagtgtgagccaccagcattagtgaaacccatgtttcaaggcaggtaccacaagctctcatgcattccttcagagcatcgtcatgtcactcagcgggttatccaacaggatgttctgtaccccattaaagaaacaaataagggaaacctgactccattaacaatcttgataaataccaaaatagggttttggttttccacatgccaactgctgatgttatctgaagttcaaacttgtaattgtattatgaagaacatagatacagacccttcttgcccaagctttctgtctgaatagcagctggaagagcaactatattctttcattgtcagagctacagagccctgggtaaaaatgcttcaacaattttgtcccaaatatctttgaactgtcatgttcatcttgagtttgttacgcctgacgcttgtatacacttgactatgtacacagagactgatttgcttacactttggaaacagcagttaatagtgaatggaaggtggttaagtaaaagtggcctttatattcaacgttattaagtaacttcttcagtactacaggtaaaaatcagaaatacatatattttaggttttatataaattgttaaaaaggcacatgcttaatcgtatgtatcaaaaacacatagacttatcttctgttgtactgatttttattgattctgcatgaacttgtgttagcgtctgtttgtgttactgtttgctcttgttccattagtctactcacagggagaacagtgaacagagttggggtttgttcagatattaaaggaaaagatggtgagtaggatgaatcaatgaaaactccatagttgtaacaattttgccagtcttaatgtttgaaaggctaatacaatcattgcattaatttaaaacatgggtttaggctgggcacggtggcttacgcctgtaatcccagcattttgggaggtcgagatgggcagatcacctgaggtcaggagtttgagacaagcctggccaatatggcgaaaccccatctctactaaaaatatacaaattagccaggtgtggtggcacgtgcttgtaatcccagttactcaggaggctgaggcaggagaatcgctggaacccgggaggcagaggatgcagtgagctgagatcacgccactgcactctagcctgggcaacagcatgagactctcgaaaaaaaaaaaagggtgtttatatgtttaattttttcctttttgtctgagtataaactaagcagtaatctgccacataaaaaactcacctagtctgagactgacttggatataaaacatgtcacattgtgtggtcaccaactggctaagtacaggacttaactgagttggaaagccaccagaagtggggatggggacacagggagagtaggataagtatggaagcttgtaattttctgctctactattttttatattttcttggatatacaagcttgagagaagtattggcaggttgaaacaatggaaaatccatggttattggatttatcagcttgtcacataattcaaggataagtaaccaggaattaagaaaaaaggtcctccaacaacagccgctggtctcattaccttgtcacagccatacgtcattaacagaaaaacaaaaacaaaacaatgatgacaataaaaaacacgttatgagggtataagagttgatatgacatcaaagtggctggttgatgccaggaatacaggggaggagaaatgaacaggcggaacacggagacttttagggcagtaaaagtattctgcatgatactgtaatgattgacacatcatttatacctttgtcaaaatccacagaacttacacccaaaaaagagggaaccctaatgtaagctatggattttagttaacgatcacatgtcagtatcggctcctcaactgttacaaatgtaccatgctaatgcaagatgttaaaactagaggaaactcgtgaaagaggatgttatatgaaaactctctatactttctgctttttctgtaacctaaaatggttaaaaaatgtatattaaattttagaaaacaactggtaaatctggtctaatatgatattaacaaaaattgtccatgtgtttggttgaatgtaactttaaactttaggacaatctttgatctaatagcccccaattctaggcaaatcactgccataatttcggtgcagagatgtattgatgcaatctcctcagctgtatatattttgctgttatttctcacaatctatcagcaagccataggaacgctgtgctttcaattatcgtattttagaaggtagaaacaagactgtccaaaggcaggcaaactatatataaaagttaccttccctttacaaaaacagtaacgctcacagcctggaatctcttgcctgagttccactggtaaatccattcacatcaacaggtgatcctttgaagtgtgagacaatgtttagataatgagctttataggaaaggggatgaacagacatatgacttacgatttcaaaaataaccgtatatggacataaagattttgaactggcaaagaggataatttcaggggagactaaagatgcatgttttaaaatgctgaaaaacagtagtttctgatgatctagtacgagactgtggtccaattaactggaagctaagctatctctccatttctgctctgatacagtttattaaatttatgttattaggctattttgcttcattgtcttttggtaaagcaataatgtataaccttcaaattaaaaaggaaagagtgaagcattatggctaaaagtacaacttatggatatttaagcatctaggcatttggactgaggatctgttaaatattaatagaccaaaaacacggagacctcaagttccaaatcaaatgtttccttggctataaatctacttactctattccttggaaataagacatgttctcataagaataaaatcttcttaaataaaccctagtaagtgtaacttcttgcaagcaaataagttttactgagtaaacaatgtcaacattttaataaaagaaataaaagacagcaaataaataaatatgcaaattagccttcaggctagatttatccattttttttcctcatcttttttcatcccttttctctttttcaccacgaggcgactgtcttccaaattgaaataatacctatcttctatatttattatccattaaaaataattcaagatttcttggctatgctgaacattgtcttgtcaatcattcctctacccagaaacaacctctgctcccctaatacctctacagaataggtgaaattccctaggctgctgctcaaagctttagaatcacagtattgtgttttcatttaatatccaattgctttcacagcttaagactgaaatcaacctggtttattaactgtgcacagaacgtgttattttattacatctttagggacattgtccatgctaaccaaataactaataaatttagcactattaacttcaaggtccttgtctatttgacatcactctctcctctttgattgtactctcttgctaatctgtagtgtatattgacttccctatagtacatcgtcacagaataaaaaaaacataaaaacttgtgtttatttaatggaatgctatatagttattaaatgaatacaccaggtgtacagatagcaatatgactatatctgtaaaacataatgtcaagagaaaaaaagtaatgccaacattttaacttaaaatacaaaacactcaaagctgcactgtataatatcttctggtatgttaataaatccagatgccataaaaatacagaagagtgagaataatacaatttttgagtggtggttacttctgggaatgaagagtgaagaatgatgactggggatttgggttgtatctttagtaaatacaaaaaaatagttgttacatttcaaattggggtagaagggaacttttttgttttgtttttgttttgtccttgatgtttgatattttttaatttatagaagttaaaaataaagaaaatctgttatatatacacaacggagtactatttagccataaaaagaatgcaatcctgtcatttgcatcaacatggagggaactggaggctattatgttaagtgaaataagctgggcacagaaagacacatatctcatgttctcactcatttatgagagccaaaaagtgaatctcacggaagtagagagtagaatgatggttactagagtctgggaagtgtgggtcagttgtggggggaatgaagagaggttggtaatgcattccaaagtacagttatatagaagaaacaagttctagtattccacagcacagtagggtaacaatagttaataatattttattatatatttcaaaatagctagaagatttaaaatgtttacaacacaaagaaatgataaatgtttgaggtgatggatatccaaaatatcctgagctgaccattacgcattatatgtatgtatcaaaatatcacatataccccataaatatgtacaattatgtatcaactaaaaaacaataaaaatgcagtcatagccacacctcaaaagaaatggattatatccaaacaaatttagtttgaatctctgctttgctacttttctagttgtgtgacattggggaaatttacttaccctttctgattcagtttctcatgtgtaaatgtgaatttctttcactgtcttgctttctctccccctttctcaaaacacattctccctctctgtgcccagagtatggtaagttattagtaaataaacatctctatttcatgctgttcagctaacagagtaagtcccagttattcttgaacctttctaatatttggcacctcttaccacttcctccttccttgaactcatgtctccactggcttttgtggtctctctctctgttgttattccgattgttctgattgcttcttctcagtctcccgtacagattactgtttctccagattattgtgtctgctctacagataactgtttcttaaatattgatttccccacagtttcatctgtggctcatcttgtcttcttacttgctatatttcttttggttgaggtcatctcttccaattactctaccactctgatgtcttacaaatattacaagcactcaagctaacatgtgttaaaaactcagttctccttttcaggtaagttcctactatgaacaggtgctccttgtcttttgaatgtcatccatacagtttcatcctcaacttctcccactttaccatcccccatatgcggttcccaagtcatatgctttcttgtatttcaaacgtcttttccacctcttttctttctatccccatatccactgctgtggccaccatctttattatttttcactcagattatttcaaatgattactcccgaatttttccacctcccgttttgcttcctctaatccacacactcccttgccaccaagctgttctttctataatacaaaactgcagataccacatctctgcatatatacttttagtagttctcaagagactttaagaaacagcccatccttggctgggcatatgtgattctgttgacctctccagactcatgtatcccctctctactgtagccatgtctccaagatgcttcctcaccacactgatttcactgatttcagtcatatgtttacatgtctggttcaagaatggaatttcttctggagtaacaattctatgtatctttctatctctgtggtctaaccaccttattagtatctagcagaaacacaaatgctatttgttgaatgagtgaatgaagtacagcatagtgttttagacacttactatactagaaatattgtttgtttgtactctagtacatgagttattttagctaaagaattatattattcatttaaaaataccccacatttcctaatacagtattatagagatagaagacctgacataaatgtctcatgaatgaataaacaaacactactaccaaggaggaaaatctaggggatcgctacttaatcacaaatgactccctccatgaaaagaaagtctctactaaagggcccatggaaatacatggagttaaatttgaagaaaatatgagaggaaataattggaaaaaataatctgtgagaacaccaatatgaaaattggtatctaactctgtctgctaaagagaattgctacttcctctggcttttatgaaactttctgatattgagacttgaaagtttttctgtaaatactagaaatgttagaagatattggggggaacacatgggtttcagaaataaaatgattttaatttttatattttcctggcagtttttttggctctttagcattttacacattaacatttctaagactcaatttccaaatctgtaggatgttagtaaaaatagtagcgatcatttattgaatgcttaatatgttttaggcactgtgctaatatttaacatggattgctggttataaagatcacaacatccttgagttaggagttattattattatactatgctattctacaatatcagattaacatggctatggtatgtcaaatatggtataatgctattgaacagattgatttcagtgaagattagcttataaatattctgtatgatgttatatgtaacattcttacttatgtgctcttttgtagattaaaaaaaatgtgtcacaagaaagtttacagaacctactcaaactcaaagagaaatcagagactaaattctcaaaactggaagctccctacagcatccacactcttcagccttgtactatgtgatgtgtattacgaatggagccaccggcagtatttgtatgaacatgagacaatgtgtggcagatgcttggtgctttgtaatatttagtaaaataaaacaataataatgtaactataatatgtgttgttcttacttgactataagtgctctaagttcagagccagccaagcgcatctttgttttctctaataggatctagaagcattctttatcttagtgactcaacgtatagtttttggatgactgtgggaaatctccctccctaatcaaagatttgacttaaaatgttattgtaaaggttttaaaaaatctactattttggctgggcgtggtggctcatgcctgcaatcccagcactttgggaggccgaggcgggtagatcacaaggtcaggagttcaagaccagcctggccagaatggtgaaaccccatctctactaaaaatacaaaaattaaccaggcatggtggcgggcaactgtaatcacagctactcgggaggatgaggcagagaattgcttgaacccaggaggaggaggttgcagtgagctgagatcacgtcattgtactccagcctgggtgatagagtgagaatctgtctcaaaaaaaaaaaaaaaaaaaaaaaaaaaaagagaaatctactatttgaaacctaagctacttaaaaaattgtacttaataaaggaattcttttctaggcttttcaaaaatcaattttattggggaataatttgcatacaataacatgctcctattttgaatttatcatcttttcgtaagtttatgtatccacattaactactgtcacaatcaaaataaagaatgtttctaacacctcacaatgtctctcttgcccattgtcagtcaatcctgatccaaatcctcaaacaaacactgaattgcgttctctcactctagagtacatttgcgtcttttaagggcctcatgtaaatcaaatcatagagaatgtactctttttagccaagcttatttcactcaacttaatgtctctgagatccttttatgttcttgtgtgtatcagtagttcattctttttacattgctcagcaatgttccactgtatgcatatactaagatgtgttaatccactcatctttcatgggcatttgagttgtttccagttattgactaataaagaacatttgtacacaagttattgtgtggaaatatgtacatgttaaattcataagaaactgtcaactgttttgaaaaatgattgaacaattttaatgcccattggtgacataggagttttggttgcaccacattctaacacttgtttttgtcagtgtttttaattttagccaccgtggtggtgattgttcctcttaaatcttaacaaatgttagaattttataacatagtcacatgtccatcatatatatattatcactagtgtagcttttattgaattgtgggccataattcataaagggttgagaccaatattttcacaaagaaaaacagaatagaaaaattatttgggtatatcacacgtaataataaggcaaatattcataaagggagtaaaatcatctctaagggggtaaaaattgggtatgaggcctggatggggctaaaatcttaatatctcaatgatttttggctctccaaaacccaagaaaataatattccttaatacttaaattctatttggttttattggccattacatgaacagcattggcaacggaacacaccccaagtgtttgcaatatatgagctatgaaattatggtgactagatggctatgactggaggattttctcttaattgactgagtgatttcaaacatatactgagtggtacctatgtgggcctattggctgccattggttgccctgtggatattgcttatgcttggtccttggtgttttcatgtgtgacttgagctttgagaattaaataataataatttatattttattattaattctacaaatgttagtcataccattacatgtcaaatgatgaaaagaaaaagttgacaatatctaaattaatatttatcatctatataagttaaaagttttctcatactgagcaaagttaatagttaagctctccaaatatttttaaagaagttattttaaaaattattttacttttgctggaaaaatagtgattttgaatgtttttataaattattatatttgtattatatattcatatcaattgttactttgcatatgtaatttgatatattacaatttatataagtaaacagattaccttaaaagtttcctggcaaatacaattataaatttatgttagctgttaagagattaaaaatttttaatttaaatgttaacttaaacattttatttgttatttaacactacattgaacaaaaaagtaaactttacacttcctttttatgtataaagcacagagatacatatagtataaagacagagtatatttgttacattaaaattttatggggaaagtgattagggaaaaaatgtttataaaaggatccttggggttgtgataatgagaaagcttgagcagcaccataattaaggacaatatttttaaatggtaatttgttttagttttatgcttatacataattaattacatgtgaagttatctagctaatttaaaattctctaatatcgacatatatatatacacagagacacactatgtgtgtgtataccacacatcctggtttggaatataaaatgtttttcttactgtagatagtggttttaaaaatactgaaaaacacatgggtgaggaaatgaatcagacttagatattaatggtaataataaatttgccctttaatgactaccttctggataccagacactctgctaagcattgcataagcattcagtacttcattcaatcctctttacatctttacagtttatatataagtaaactgagtttcagagacataaaacacctacctgatcacagagaatgaattagtggcaaatctgaattcagaatcaggtatggcttactctaagactcaggctctttttgctgtagcttcctgtctcttcttgacctcaaacagtgtataggatagtagttatatgaataagtaatgatgaaaacatggcaaatgctataaaatacatccaggaaatgagtcattttatttaacaagcatttatgtacattatttagccaacagctttggagtgtgatttccacctttatctgtaaaataaggcaaatgctgctgctgaccttctagatgattttgttaagggttaaatcagacaatgcaggtaaaggggctgagagcacaggaatggctcaagtatttttgagtgttgttagctgaatgttgcagacaatataaacttactggaaacactctcataatccagttccacatgcaacatttgcagaccctgataaagccatgtgaggatgaagttaatccagtgagtgctatgggtattcaagaagcaaagttggccgtggtattcggacaagacaaatgcaggagaaagacctttacctgaactctgagaaatggagagggctttggaaaggcagaacacaagccagggccagaatagaaacaagatacagagcaggaaatgagcttggcgttctgggaatcggacttggtgaaacacagactgggtgaataatggaagacaaaacaagaaaggaaggctgacaccagaatagggtggtgagaaatttgtgctcagttctttgagcaactgaaagtcactgtttctggtgagatgaatgaaacgatgccttttaaagcttacttcataaaacagtgacattatacaacaggagaaagacttgatgcttgaaaactagtattaatatcactgcattagatcagagacatgcataatgaagtggatgataatggcagtgatggaaatgaaatataagtttagcttggaacacatatctccccctcctccaaaataatcaattgtgtttagatgggatagaagaagaagaagaagtaatgacaactctgtgatttcaaggcctcaaagaaaatgagaaaacactgccatgaataatgtagaaataaaggatttaacaagtctttctctttgtacttacagctaatataattacaagcaaagcaatagaagatagatttagataaaatattataagtcaaaaatatggttagatcttcaaatgtcattttggaagccatgagtatggagataatggctaaagctctcagaatggaggagtcactgagggcttctgctcagggctgaggaaggtgaacagaactctctagcctgcggggatgaaattgcacatacggcatcctcttgagttcagatggtagtggtctcttgcttgtattagcatacatttattcacaaatgtctgtaagatctttgctttctcacataaaaggggacagatctctgtcactcaaattaggctatcttccaggttttcctaaactgtccctggacaaacaaggggtccccctatctgccacactaagcagagtagtacaacgtgattcagtggggaaaaccatggtttgcatattacatttattgttgagtcttttaaaaatgtaaggttttcttttttgtaatatatatgtattttgatcaatttatttatacatttgttacaaatgctagagttatgtaagtttcatccatatgcaccggatatcctaaggaacaaagggttgcatccctactttggggcagaaaactctcagatcttaggcagtaatgcatattaattcattatcagctattcacagggtcagaacatgatcatacaggagaacgtgataagttctcctatatgatcacatgaggtatatgctgccatttgcccctccaaaaaaataggatggaaaggaaacctgaataacaaataatggtttgaatgtcaatttgaaatgatattaacagaaatttttttcaagtaattaagcactatttcactattcaaatattgctgaaataagaaacatggagatacatatatacacatatacacacacacacatatatatttttatgtttgagattgaagaaagcaactgaatgctaatagatataaaattatttatatttactttttgttttggcctaaaatcttatcaaggctgaaatgttttgaactttaatatgatttatgagttagcatacctgatttcaggaatgttaaatcaattaagctaccttactgatattttatgaacactggtggaatgtgttttatttcacagacatacttcttttatattgtgaattactttgcctctaaaatacgcttcccactgaattttaattttcagtttattttcattgtatactatacaaaattttgtctttgttttgtatttgaagcagagtatattacagtaaatttcacagaggttatttgtttaacttatgtttacttgaaaataatttaatattagtagaggatgcagaaaaaatagatttaattcatactcactgtggtagtgttgctggcagggaacgtctaataatggaatgaacttgtctgtaaacatccagtttagacatgcatcggcaggaagtgtgattggcaaaactgattgttactggtttggggccttgagagagaggcactgtaatttcaaataactacaaagaagggacaaaaagaagaaaaaattatatagatgctgtaaagcacttttatggtaaatattggagtccgaaaaagagtgagattagctctatataagtagctgcctagtgtacgcaggacgctatgtttttatgattacaaagtaaaaactgtcttgctcctaaccagtatcttttatcagagtaataaatactccatatgtttatcttatgtcactagttatgaagcatattagaattaggataaccaactaattggttatcctattagacgtgacagaacaatgtgttcaagaaaaaagaactgtttcaaagttatagattatttgaaatgaacatttaaaatattccagggatttaaaaagtgtcacacacagaaacatctttgtgatttaggagcaaagctattggccacacaacccagaaatacttggttatgacctactttaaataaactgaatacatagacgtaagttacatagatgtaaagttaatttttattaaatttctacctcaatgtagttttatatgtcttagatctcttataaattgattatgtttaaaacaaaaaaaactacatttataatttaatagataaagccatgtttctgctatcttggtaaaggaattatgaaaataatgagcttaaaataaagtagggcattttacacaattctgaattacagtcaaaatttagtttaactggtctccttctgaacgccttatttatggatcaagaacttcttgtgttctcttccttctccaaaaacaatgttttaaattaaataaacaaatacatcattgattaagtaaaactaagtagatttaaattcctagtgttcttacactctaaatcattaccagaaaaaatggtaaaagtgaaatcttgcccactaactgcttgataagatcaacttgcagtcatttaactataattgatccatgtattacttggtgtcttcatgacaatctgagcagtgataaaaaagatgacaaacttcaaagcattgtgacttggcctttgctgaactttcacgccatcagctgaagaccattgaaaatatttatgggataggattagctgccaattttgtccatgccaacaaggagactttttaaatgaattctgaataatgaaatacagaaatatgtaaattataaaatgcatattgtcttcattcaagatgtattccttatatattcatttaaaatgtaactactttctttagaaaacaatatgctttagaagaaataggtacagggttatacccagacaggtggcttttattagctctcccatttataagtagcataaatttggaaaattcatttgacttctccaagctgtatttttctttgataatcagtaaactaaggataacacttgactcattattctcagattataaagattacataaactaaatgaatctgatatgtatattatttgctatacagatctaagttattactatttgtgtaaattctcaagattctaggtattctccacaatactgtctgatctgcatagataacttcactatgtgacctcaacatatgccactattatgattttgaccagtttcttatctaaaaagatacccgtttatacacgttggataaaatctttgattaggtgaaatattgcaatggcagtaatcctttgcactatatatacctattttaagagagaattctgcagtgtcttcataagctacaatttttctatcttttaagacatctatggaatctatattaagaactagcactacagaagacatacaaagtggttttaaaaagcaatttttaataaatttataaaattacttattttttatatttgtataatttataatttgattatttaagctctgcaataatgtagatggtaggaaggtgtacctaagaatttaggtctagtaggcagtcacatatgtgtgtctagagtttaggagagccattgaaaagtcatgaacatttaagctgtaattggagtcttggacattgatgagattacttgatgagcactctaaatgaaaagagaaaatgtctaagaatagaaacctggggcacaggaacatctatgaggtgggaagaggcaaaggaactagtgaatatgtctgggaagaagcataacaatgatggagcatcaggaggggagactgtcaagccaacgggtgccagagaaagaggggagagcttcaaacaggtgtgtgtggtcacagggccacatgtcttcgggaagtcaaatgtaacaagaattgacaggagataaccagcacccgatgtggttccaagggctgtggcagggcaggggctgtaggaaggaagcagcagtggagacgggggacaagaagaggtgctccatgtgactagtgggaaagggctcaagtggctcagaccagcagaaacaattttgcttacacgcacagtgtttgtaatctgatatggtttggatctgtgtctcctccaaatctcatgttgaaatgtgattcccaatgttagaggtgggagctggcgggagatgaatgggtcatgggaccagatccctcatgaatggcttagcaccatccttcggtaagaagtgagattttcctgttagttcatgctagagctggttgtttaaaggagtctgagacctctcccttccctctcttgctcacactctggccatatgacacaccagcgcccccttccaccaagattgcaagcttcctgaggcatcaccagaaggtgagcaaatgccagcatcatgcttcctgtacagcctgcagaaccataagccaattaagcctattttctttataaactacccagtcttaggtattcctttatagcaatgcaaaaacaaagtaataagtaagcacagcaggatttggcattgtctccagtgaaaccaggcaggacagagcctgatagtgaaggtaaggcactatttgagataactaacagctattgtagaagagtttatgttttcccacccctaacccttggcagcatcattcctgctcccactgatggctgcccttccagattctgccccagcctgttttccaaatggtagacagattgccgtgagcagtatcagtgatcatggagagacctcatccatgcctaggtagataatgttcacaaatcaggatccacccatgggtatcaagcatgaattcaggaacagcagctttgaagaatgttctggtgagatgaagaatagctaattcacattaagaaagcatcttcctggaaaactaagtgtggctctatgctttcaaaggctgcaagaaatgtgtttttgaatacactgactaaaagaataaggagacaggtaaaacagcactaaaaccaaatcactgtttagagaactgtcttttcctctaagttgaagacttttataagtggtaaaatggaagacttttttacagttggagagaaaaaaatctttgttgcagtttaactacttaaaggaaataaaggaaatcacaacataaaggaatcaaaatcaaaatcttaataactaatgtctcatttctcttttttgtgtctaagtagcaattggcaggctgaattcagttaattttgtcaaaaggaacagagattgaaaaattaaagttaaaaaattttgttcttctcttgaaacacatcctctatccctaaattttgacctgctacttgatgataccagtgtgaaaaaattttaagagtccagagaaagatacctttgataatattaaaagtagaaagagtcttgataattgagttttatttatctatcaacttcaggaaaattagtaatatctactgggaatatgccatctgggtatgtattaagatataattgtacctataccagctcttgtcacatactaaagaggcctctttaatttttctaattctttctgtgctggtctcatgtgtgtatattgactgacttactcttatcagttagacatgattacagtttctactgccttttcaataaatatagtaaattctattttcttgtttacagaccactttgtgaatttttacatagctatatttaatccctacgttactaagaatttccgtaagctttttttcctagatagtatgtgcttagaaaatatacattttttgaactgaaaaaataataattagaagtgcattataaacttgcatggcgccctcccaaaataaatacataacattttcaaatcactggcaacttccctactccacgaagtatgtaagaataaacaagagtttacttagtcttgagaaacagacagtaattagagtcctggatcttcaatttactacttctgagacttggaaaaattacctaacttccccaagcctccatttcattacctataaaatagggataataataatggtgatttcagtgtaatgtttggatttctcttcctcctcttctttctcttgttctttatcatcattcacatcagccaagatttagttaaatttttgttaaagaaattctaaattttaaaatttttatttaaaatctttccttgtttagttttcagtaactatttattcagtacctacatgataccaagcaccttgctagaatctcaggataacagtcatcagtaatgaccttgcctctatgctgatcagaaacctaacaatgagggcggggcatggtgactcacgcctgtaaccccagcactttgggaggctgaggtgggaggatcacttgaggtcaggagttcaagaccagccggcccaacatggtgaaatcccgtttctactaaaaatactaaaattagctgggtggcgtggcggatgcctgtaatcccagctacttgggaggctgaggcaggagagtttcttgaacccgggaggcagaggttgcagtgagcccagattgcaccactgcacctgcactccagcctggccaacagaggtggactccctctccgaaaaaaaaaaaaaaaaaaaaaagaaaaagaaaaaaaaagagacctcacggtgagggtgaatgagaacatacatatacacagagagagatactatggtagaatttctgaaataccaaatagcttaccgtaaacactggagtttaattcccttatgcaatttgttcttgccattaataatgatctgaactaacatagtaactagaatttcctctcaaaagagtttagatctatccaaacatatcaatgtttgaaacagtaagtagattattttaagaaaatatgaatcatgatactattgtcagactattttgtgctttattgtgtatataatagtattttctgttctacatttaagttcatagcacataaaatttatgtattattcagcactagctaatagctccaagtatgtttatttagtaaatactgattgatgatgtatttaactgataatgtatctattataatttgatattttgaaaattatgatttttctaaaacagttttatacaataaagtgaattgttctgaaccaataagtaatattaacttgtgtccaatgtaggacacaaaaaaagttgtaataatacaattcattatgaagcctgacatatactttaggcatataataccagttgttggttttggagaagatcaaaaggacatataaaaaaaggcatttaagcaaggttggaaactgaaaaaaaaatctgactgtatattctgtaaaactataataaacaagaggaaatggcaagtgtttccaactgagaggttcccagttgtaatctactggcattctttaataggaatatttaatagtcaattctcaccaacaagaatggacttcaaataaagccacattttgaaacaataggttgtttacagcagcatagcaacggctataaagcaacaattcctaatcgtacttatcttgctggctattcaagaaaaaggtgtagaacttccttactgagaggatcttgagttataatttagtactaaattataagtaatgtttgtgtggatacaaatatgacacaaaaaatgccttcctttaaaacaccattatatcctaaatataaccagtttctcttcagaacaaatctcactaccatatttaatttaaatttaaatattccaaactttagtccattaagtacagatatatgtacccccagaagaatatgattaataactataaaatcagattttaaaactacaacgaatttaaagaaataatgccccaaaatgggaaaaggtcttagcattttgacttagcattgcaaccacatggccagctataaaaggcctgtggaacttaaattgggtttgggaaagaaaatggaataacagatagcctaacagatttaaatctggtactgaattaattttaacatattgttatgcataaaaagtatacacagtaccacaattaaaataaaaacctcaattgaagagttttagaaatactgaataaaatacgtgaatctcattgtaccttgggttggaaaaaagtggtatttttcacagatgcattaattatgttcttaaggcaaatgttattcttaaagaaagttctgataactggtactggcatagagttctttttccacatcaggataaaacctgatttccaaaaactgtgcttgccaaatattaacttgctaaagatacaatacaaatcacgttccacttgctgaatacaaaggaatgtaataaattaatcttccagactgctgcagtattctgtttaattaatggaagaaatatctctgactgcagtgcaaaataatacctctaatttcattatatagttgcatattttacttaggtttaaatattttttgttgtaaaattttatgaaacatccaacttaaatataatcgagcatgtctttgttaatatacatgctcatattattgattgctcatattattgctttataaaataatgaaaaagaagtagctgcttgtttttaagatggcaatgtagaatttaaaataatgctgcttctatgtatcagaattagctcatagcaagctagcttcttaactaaactggcttctttagtctggcactaatgaacacagcaaagaacttctagttccttgagcttgatttaaccccaccattttcaggaagactctagagattgagctgtttttctttattctttcctagatttagtaaaatatataaggtaaatactaacattcaagtaacttttaatccaaatgtgtgcctcaaaagcagatgactttcttctgcttctgctttcatcaccaaataatttaccccctgcaaaattcattttctactttttggttatatctcttaaacatacaacttctcataagaaaatatactcaaagtgtatgtttatgaaagaggttgaaaagacatccaatctacttaacttttcaaagccacttagatacttgtgtggagaactttgaagcagtttttatccattagtatactttggaatgcacagtgcatatgcttttacttttcaatgaacagctggcttcctcacacgccctgataacctccccttcattgagtcccattttaaaaaagcatttctatgaagtatctataaaaaacttgagtttaacattacctaaggtacattgtccttacaatttacatcatgccaattggtggctttgctacaaaatgtgcctggaactcttttaacaaaacgaaaagtcttttttttgtttttttttaccttaagaaaacacagcattaagaaatttccttttatatttgaaggaaatcatcacacactcccattcatactacactgataatgcaataaattgaataaactcaggaaaagctgctacttaagtacacgttttcagaacttggaatattagtaaaaatgtaggaacactgcattcttgctttcagaaattttatgcctcgacctcccttggtttataaacatcctggatatgcacttccataagcctttgtacttttccttcacaacacttaaactacttttaattacttgataaatgttgatttcgcttgctaatttgttagttccatagggcaggatctatccatcactgtacacctacactttgtgcatagcatgcttttagtacataatatgaagcgtcacataatgggtgtaccacatgcacttgtctaactgaatttaaattaaaactatctgccgggtgcggtggctcatgcctgtaatcccagcacattgggtggccgaggcgagtggatcacttgaagtcaggagttcgagaccagcctggccaacgtggtgaaaacctatctctattaaaatacaaaatcagctgggcgtggtggtggacacctgtaatcccagctactcgggaggctgaggcaggagaatcgcttgaacccaggaggtggaggttgcagtgagccaagatcacaccattgcactccagcctgggtgacaagagtgagactccgtttcaaaaaaaaaaaaattccttatactataaacaaaaatataagcgaatcctttggataggaaaagggcatgataatacaaaatcaaagagggaaatgcagggcacagctaatgatgaatgttggctttcccttggtactgatgtttgctcttctcttgtgatacatcaataccctaagaattaataagcacaccaggcttcaaatgacatttatcagaatgatgcttcctcccaaatctatatttaaagacccagttattgttctaaaattttagaattgtacatcaaaccttctggtatctccacctaaacaccattcagactctttcaaatcagcatattcaaaatttgacctttgaccccaaatttgtttctttttattcaaatattcattttattcacttctaagtgtttgctatgtgccaactactgtgctattgttcagtgtaacaagcagacgcaatctttgttttcatggagtctagaacctatggaataagactgggtgcagtggctcacacctgtaatcccagcactttgggaggcagaggtgggaggatcacctgaggtcaggagtttctagaccagcctggctaacatggtgaaaccccatctctactacaaatacaaaaaattagccaggtgtggtggtgcacacctgcaatcccagctacttgggaggctgaggcaagataatcacttgaacccaggaggcagaggtcacagtgagctgagttcctgccactgcactcccccacctgggcaacaagagtgagactccatctaaaaaaaaaaaaaaaaaaaaaacctagggaattaaacaaagataaaacaatctgacagataaggtaatgatgctaagatacagcaacaatggatgctgtggaagcacataacagaatgtcctggaagtcacatttatgtttaggcctaaggatgagtagacattaactagatacatcgagatacgggatcatgtgtagggagatgtttcaaacacagagtacagcattgcaatactggaggtgacagatattgacataacccaagaagtgaaaagaatttgggtcttagtggtaagtagtgtttgtggggaaaagcattgacatttgaggctggacacttaggtagcatccagatcattgagggcccaggaaattatgtttaagggattttgtctgaaagaagagttccattcaaaacactaacaacttagaacatttgtaccaatcaatctgaccagatgctggcctaagcaacccaattagaaaagataagcttatcaccacactagttgaatgctggctccatcccaataaggcaatgttatcaaggagtttttagcagtatctgacttagcattaagaaaagaaaaaaaaatcactgctaaaaagtggcaaatagattggaggaaaggaagaatggaggtaggagaccagttattaggcttgtccaagaggaatggtctaggtaaggggtaaatgtgacctagatcagagcgggattagcagcgtggagacactggataggtcctagagatgtttgcaaggtagattgaatagcaattagttttggtgaaaggaagaataacttggcttgaccgactggctgaatgatgatgtcatttactaagacacagaacactggaaaaagaataggattcacttacttgcttatttgggcaaggtggtagggaataggttctaactgttaagtgagacagactgacctgtctgagggacagccaagtcacaaggttgagtggacagtatagaaatcaggaaagaagcctgaattggagggaaaggtttgggaaaagtaaaaaaaagtagatgagaaaatacaaggagagttacagtctgcagagaaggtgtcttaggtcagaattctcaggagaaataccatatttttgatgaactacaaatttttaattctcaaaatcttcaaatctttaaaaaattaaaatgacaaaataaaaactaatgctatataaattttaaaatatgactgcattacagatcagaatgtataaatattgtgattattgtaaatatatagcccaccaataggatagaaaaaaaactgaaaaaaaaatcaaccaataacaaaaaagcagacaaacttcagaaatttcatgggcaagtcctgatttttcacacaagcaaatgattgggaagaagttgacaaaactcatatcaacattgtaaatctattataaaagtaagcctaaattctgcaaagctgggaggtgaaagagatgaaatacagcaagaaaagattccatgtgatctaaagtagacaattttcttatagcaaatatctgatgtttaagtactaagtagactgggcaaaattatttcacctatatgcagcttacacttagcactaaatgctcatcttacccctggccccttgtaatttttttcttttgttttttttttgttttttttttttttgaggcagggtctggctctgtcacccaggctggagtgcagtgctgcgatctttactcactgcagcctctgccttccaggatccagcaatcctcccacctcagctacctcccgcgtagctgggaccacaggtgcacaacaccatgcctggctaatttttatacttttttggggagacagggtttcactatgttgcccaggctggtctccaattcctaagctcaagagatctgcctgtcttggcatcccaaagtgctgggattacaggtgtaagccacagtgcccagcgaagccttgcaatttctaaagcctaaacctctccaacacctccctcttgatagagcaatttttatgctactgagcatacacacctacccttgaataaatactttcactccaatacccactgggtgaatgtgacacctaattagaccaatgcagaaaatgaatatgcaatggtcacagaaaaaactcaaatggttaatagaagactaaatttatttactttgcttactaacaatgtactgattttctgttttccaagtttagattttacctaaggtatgcttaggtatctatttggcccatatgtaaagtatgcatttatttggttgaccaatagtaagaaagatataatgttggcttttgctcatattaactaatgaatgagagaataaagaagaattttcttccttatctgtaagagaaacagatatctatatctcatctagtcatctggatatctagatatagatatagatagatatgtttcttttacagatacatatatgtatatctgtatatacatatgtatatatatacatacatatataaagtttatatttaggtttgggggtccatgtgcaggtttgttacatacgtaaacttttattttaggtttgggggtgcatgtgcaggtttgtgacataggtaaacttttattttaggtttggggttttattttaggtttgggggtccatgtgcaggtttgtgggtccatgtgcaggtttgtgacataggtaaacttttattttaagtttggggttttattttaggtttgggggtccatgtgcaggtttgtgacataggtaaacttttattttaggtttgggggtccatgtgcagatttgtgacataggtaaacttttattttaggtttcgcggtgcatatgcagatttgcgacacaggtaaacttttattttaggtttgggggtgcatgtgcaggtttgtgacataggtaaacttttattttaggtttggggttttattttaggtttgggggtgcatgtgcaggtttgtgacataaacttttattttaggtttggggttttattttaggtttgggggtccatgtgcaggtttgttacataggtaaacttttattttaggtttgggggtccatgtgcaggtttgttaaataggtaaacttttattttaggtttgggggtgcatgtgcaggtttgtgacataggtaaactcatgtcatgggggttgttgcacagattatttcatcacccaggaattaagcccagtacccaatagttaccttttctgttcctctccagaaacagatattttttaaaagatcaagctaaattgatagcataaacgtttgtttagcaaaaagaccaattatttgaaaattccacaagtgtgttaatcagctattttattattaataatcttcaaggcagcagttttaaagcctggtttaaagggaaaaggctaggggtcagggaacaaactccctaaaactgtggggggaaatgctgtggatgtgtctatattttcatttgttctcatgaaagggtccacagtttttatgtgatactaaaagagatttgtgcactgattctgtggtaggcactgggataagtagtgaacggatctgtttttgcctttgtggaggagggagacattaatcaagtaacaatgactacataactataaactatgtgattataggctgtaataaatactattttaaaaatatgggaaactataaagcatttactacaaatattgggtctaatccaaataggtcagaaagtcttgcctgaggccttgccaaagccacttgacacccaaattaagatctgaagagctagcacctcaggaaagaggagacaggaaggccaggttaacctaaaggtgtgtgtgcaagggcccaggagcagaggaaacacgatgatgcccaggaattggagaaagtctagagcactggaagcacaagatcaagaatcattacattagatgatgctgaacaggggctatggggcagagattgcaggttgtgataaagatgtggtcttgaaaatcctgcatgttctcatttatgtgggagctaaacgagtggatctcatggaagtagagagaagaatactgattatcagaggctgggaggggcaagggtagggaggatggagagaggatggttgaggggtacaaaagcacagttaaatagaaggagtaagttttagtgttcaatagtacatcagggaaattggagtgaataacgatatattgtatattttttaaaaagctgcaagagaagtactgtattgttcccaatagaaagaaaagataaatgtttgagatgatggatatcccaattaccctgatttgatcattacacattttgtacaggtatcaacatataacacatgaccccaaaatatgtacagctatgatatgtcaataaatataaccttcaaaaaagatttttgtcttattttacaagcaatgggaaatcactgaaaggcctttatgctggagactgacatcagctctgtggggtttttttgtttttgaaacagggtcatgctctgtcacctaggctgggagtgcagtggtgcaatcctagcacactgcagccctgaactcctgggctccagcgatcctcctgcctctgcctcctcagcagctgagaccacaggcgtgagccaccatgcctagccatagatttggatctatgtttttaaaaaatatgcttgaaagtaatttatagaaaagattatgaagaaaggaaatggaaggaggaagagcagagagaaggttatcttattagttggaaacagtatccaaagtaccttggtttactatttgatttaaatcaaataccatattaggaatataatctagaatacatcatattgcttaactgaattattttaaaatataaatcattaacggcattccaaaaattgtatatttcaattcctaaatcatccatatttattttctctaactttaaaaggaaatgacatatttctcaagagactcagtataccaaaattcccattaagaggtttggcttgaagataaaaacaacattttaattattaatatgttttaaaaatgaatattacctttcaaagaatatctgcttggcctaagtatttctatttaatttattttaaagtatgcagttctaaaatttagaggatcttaaagaatcctgtttgatttcagggttatgataaaatacataataccaataaaacctgttaaagtagtattaatttatttagaatagtaagtacaaaactataacgtcttattgtttattgttgtttgataaagactcagggaggataaatgaactaaggataacttttgctatgtccaatagtataattatatgttagtctatcaaaaatattataattttggcaaccactgaaatattgtcatgttcctacaactgtacatttttctggtaaagtttctaaatgcaggactatgtttagagtcacattgtattccttgagaacacatgttggaacgacccctacattattttgctgtgcttttaggaaataatcagaatgaattgcatctggctaagcttaactaactatgatactaaaagaaatgatagcaggccccaaagcatcaccttttaattttttttaacctttagagttgaggcagaggcaagctgaatagaaaatttagctttataatttattttttgtttcttcttgcaagtcttaatctaaaatggcttgtttctttatcaagtgggtgagcaatataaagaaactcaatttttgaaaagaaagcaattaatttgggttgtataataagacaatgtctccaaactcagaggccaaatgatcgtaacagtaaaaattttggaaatattcagctagctgaaaaaatgtagttcatggaattgagatagtaatcttaactctgatttctattaatactatattgaaataagagtaggttttattactgaaaaccatgtagatcagctaaagtttgcataaaattaaaatgtgaattttctgtcataccacatcatacaaatcaaatctaacaccacatctttcaatttcatttttcattctccaggtcaaagaacagttctgaatttagccagatttacgtgtgtgagtctaactccaaaaatagcttagaaaggtcattaggacaaccacagttttgtctttcgggagaagtttgcttcagtccagcccacgggactggatttctccaaacatttctgttcagaggccagaggtgcacacaatttcaaacaacactttcatggttatcgccagcacatacgcgtgttccacagccagcctcctctaccacgtaaggcccacaaagcgggtttatgtgtctggtctgaaaatccctgatccaaagccaaccttaagagacatttcctggttatcagaagcttaccatttaatgagataaacttcccagtttattcaaaacatctgagatttagtgtcagagttatttcctttgctttcgacaggaagacaataaatttcttcagtgagatggcttatttcaatactataccactgtttcacagaacacacgcatttaattttacactttgaatactgtttgcactgttatctccaccatctgaaaactcacccatttaaaagtattttattgccaaatgaacatgtttattcttgaagatcaacacacacacatacacacgtacatgtacacacatacatacgtatatttattgttttctgcatgaggctttgactccactatatgaagagtttgcaaagtaataaagcatcaattactttctttgtgacactgtgttgtcaaacacacaaaacactgaaaaactgacttcattcccctaaagaaaatatgagaccctgagttgaaccaagttagtttaaagcaaccagaagtttaaacacatcatccccaaagttaaagcttctgattaagggggctctcgcaggtagcaggaatgggcaatacccaccgtcttgctgaggtagctcgtgctggtgttcatgcactgcagcccctcactattgcagcaacccccacatctgtagacggacacacatggaggtttaaagaaggtgtttgtcgcgactccaaactccttccccacatctatacacacctcccgtggcatgcattgagtctttctccactcattatcaatacctgtcaagtcatagggaaatcagtaagttttacggaaaccaccaagataaaaaaagcccacagcagctgcaaatcactcacattcatttcagattttaacatttaagttcaatatataactaaagagacagctgatgggatcctaaattgacttgtgaatgagaatgatataacattgaaaagacaagctaaggatatttcttaaactcatttctatagctaggcaataagaaaaattagcattatgctttattaaaagtacaccaatatcccacaacactaatgtttggtttttctttcttaggaaaatggtaatttaatatatgaatgtttataagatgtgcagagagagtcatgttcattctctatagtatgggccatttttgtgctctcaatgcaaatataaatataattttatttttctttaaaactgagttgcatatgagaagacagctatggttttagattcaagtcaaacgtccttttcaggcggactatttggcaaccttgagtaatgtcgtggctgcagctacataaaatacaaggctatttttcaccaactgggactcattctgaactttcttcagcaaagtcaatatttcctatcccttttaactctcctctggaattttgtttctgatgagttagtagcttacctataatactgttgactttttaaattctgcattacaaataatgtacttcctaagtatactagtttacttatcccatatttcccctaaaatagaatttttggaaaaggacataaactattggttatacaaccatgaagccattttgtttgcctctgttctcaaaatactttccaatatcaaacttttatagcgattaagagctaccaactgaaggcaaatatgtttttaaattactccaccactttttaattttttttaatagagatgaggtcttgctgtgttgttcaggctggtctctgactctggcttcaagcaatcctcccactttggcctcccaatggtctcggattacagacatgaacctctgtgcccagtcataccccaccaattgatgctatgacattttatgcaacatgatcattttttgtgaagctttatgctagatacctcatcagcttaagtcccgctctgagccagttatctgtgaagcagcaaagcaacaagtgacatctgaaaaggtgatttcaaatgaagcatttctcaatccaaatcagataggaaattaaggtataattatttgataagataaagaatgtttaagttattaaacagatatagtatgtaaaatatagccatctgttttaaaaattttccaatggctatcacctgaaaaaataaatgtgtgttgtttatgcatggacctatctatcctgtattttatgaagtcatcttaatactcaaagtgaaatcataaaatgttgtattttgaagtaattctttattttctatttgctttccgccctaaaggtgtattcggtgatacaaacactgaaattaaagaaccaggctggcaacttctactggtttgatatataaggcttactatacattttatttcccatacttacttttcaagatctctgtattataatgtgctgcagcaaattttatagtctcttctgtccttgagttgaggttggcctgttctctgttatgttgccagcctcctttccttagctgacacttgtacattttccaatattctgggtagagtacagtcatgagttcatctacactggacacagaccgtaactgctcctccagatctttgcttgcataagcctgtcaaagaaaaatgcaagatcaatgacttaccagcttaagggatttagaaacaaatgcactataaaacggttaggtttaatagtatctatgctccgttccctaacacaaatattattaattactcctaaattacttcactttccttggtaaaattatatttgtattttaatttgtatgaaccaaaacaattaaaaatacatattttgttgttaggaaaaaaattttgtgatataattttaaaataattttaaggtagcttatttattttattcatagctctttcaaataattggtcaatttgtatgtttgaaaatttattcatttgtatcactctactaaacagataaaattacactgaaatccaccctaatgctttgctttatttttagttaccagcaacaatacaatatgcttaagcaggatgcttgagagtaggaattttactttcatgggagctattttagaacaaataatcatatgaagaaaggaatttcaacaacattgtcacagtaagatttatattttggcagaatctctcaatatttaaaagaaaattttatcatcaagattaataccaccttcatagaaatgaaatagttcagagaacactaaatcttattgacggctaactgcatacataagtatactcatttaagtagaacattccaaattatattttagtagttaccatatctaagaaataaatacaatttttttctaattatgctttagaattaggaaaaaggaaacttgtatagctttatctatctgccaagtaaaatacaacatcaattgtttattttatattgtcatgattatcccagcttttaaatataaatatgtaagtaaatactttggacactggttctcaaagtttagtcgaataagagtcaatgaactaactgtcagaaatgcaggtaactgtcccccacctctccatggtttcttgggtggatcaagaacctacattttaacagattatagttttcctgtctaatttttgagcacaaaatgaacatatttgccttaaaattgaaatcttatttaatctgaaaagtatttttcacttctatttttaataatcgaagttattctatgtaagtgatttttgtaccatatattgagaaacataatctaatctcattttttaatttcattataacagagcctcctaaaaataaaagtcaattattaatatgaaatgtgttgttccctattagataatgaagttggctgtgaatgttgagtttaccctttcactaccatttatggtatgatttgagtatatcacttaatctctgtaggtctatgttagaaaaatatttatattattccattactttctgaagtatatgggatgattcctgatacaccatacagccatagaaaatctactgaatatgggaagggtggaggtggagaggagatcttagtttaaatgaaagttacaaaacatcctctcacagtttcccaattagatgtttataaaatatttgccaaaaaaactcacttatgacacaacattcaaaactcaaaagtgtttcagaatctcaaaaggttactactgaagggaaaatttataaaagtgattataaaaataacaatatgtgaggtgatggatatgttaacatgattatgataatcatttcacaatgtacatgtacagcaaaacatcgcatcacataccttaaatatataccatttttatttgtcagtcacacctcaataatgttggaaaaaaaacagtgtacaggtgtatttgtggtcactgttacctgcagtaaaatgtgacagatcagtttttgtttgtctctgcttgttgaatagccctagaagaaaaggagcaatagggacctgtgtgtgattggaaggttcctggaactctccactacaagtcagctgtgattcaagacaggttgtgacctaaactgatcacatctatttccagaacaggtctgcatgttcagcctagcaagaggagctgcaatacaacatccttacacaatataataaaagatattcaccgaactgttaagaaagggatgatggtagacagagactttcaattaagtattatttgaagttttaagacagacaaattagtaccgtaaaacttcgaaatgagaaataactataacaatatttatatttattaaaaaaacactgttcctcaatagatcagctggagaaaaacataagcataacattcacaatagagaaaatgcaatattaaaaaatgaaaaaagtagaaaagctattatatttatactcttaggctgaaaaaggcctttttaaagtgaatataaaataaaatgaaaatttttgtatggcagaaaacactgcaaacaaattaaaagacaataaagtacgaaattatttgcaatatacataatggataaaaatggactaatattcttaaaacactgcatgaatactggtgcttcaatagaaagatggacaaagaaggtgaactgaatattaacgaagaagaaatataaataatacatattgtatgatggcaaaagtgaaagaaactataattcttttcaatccttttcaatctatatctaagagacccccagactaaagttcaagttcattcttttaacaaattagcacctgaagttttcttgcatttgtagcaattagcacctaatttgttaaaagaatgaacttgaattttaatctgggggtctcttaggtacagattggtttgaggaacctgagtagaaagatatcactaaaaatggaccaaactagaggttttcaggggagccagataatatcaatgagaagatgcatgactcattagtttttgagaaaagaggatttcaaacccaatttctccttcagtggaatccgtgaaagtggatggaaaggcctgaataaataatgtaaacattgcttagctattcagaagataacatatggagagaagaaagaaaacacattcattgaaaaaaaaaaactcttcagagagcttttttttcagaagaaaatatttgtgatcatagatgaagcaaagttttcttacacttaataccaatagcaatttacataatttttaaagtgacaaattatatttccagaaaatcgaaatattctgctttccataaaacacacaaatgataaacagtgagaaaacatttacaaagcacataactggtaaagacttgtatctgaaatataatcaaaaacacaaacatggacaaatgatttgatcaaactcaccaaagaagataagcagtttacaaaccaacaaaaagaagtaatataatgcattaaattagagaaatgcttattaaaaccttaataagacaccactccacacccattagagtggataaaattaaaaatacaaccctaagtgctcacaaggacgtgcagcaactggaactctcacatgttgctgttgaaaatgtaaatctgtacagccactttgcaaaaacagttgggcagtttctcacaaagttaaacatatacttactaaaatttcagtcctgtatagtatctgtttaggtgaaacaaaaacttatgttcacataaaaatttgtatgcaatatgtttatggagggtttactcataataatgaaaactgaaaacacccaaatgttctttagctgggcaaatggataaaatgtgattgtacattcatgtaatggaatatccaacaatgaaaagaagactactactgatatctgccacaataggaacaaatctcaaatgcattaaaacaagtaaagcaagccagattcaaaatgctacatgatgtgtgattcctttatataacattctttaataggcaaatctacagggggagtaacagaagtcattgtaaaaggctagaggcggagaatgagtatgaccacaaagtgtcaccagggaatatgtttgggaaggggagaagtgatgtatcttgactgtggggatggtggttatacaactctagttgtcaaaactcgctataaacagtaaatttctccatatgtaatttcacccttattaaaaagaatagatcctaaatctaaattttaaatacacataaactgagagctaaatagaatttaaaatttcatctaaaaacttaaacccaaagaaactaaaaggtaaatttaaaggggagacacaaccctaatgctcttgatttctcagcaatctaaagaactttaaaaaaataattttgctttcattctagaaataaattgcttggtacaaacaggattttatgaaatttcttttttgttgttttcagatggtaagaccttatcttctgagacctctgagttgacagcaatattaaattatgttgaagatcttgacaaaactagtaatctgtggtcttatttgtgttttgcttctagtcaccagctaggtaactttgaataagttactaaaattctctgggtctcagtttctccatttataagacagtgagtataataactgtaaaaacttctattgctttatgtttttatacataaacatacaataagtatggccaagtacaataaataaaagattaaataagaaagtcaccaagttacttctagtttaggtgaaatccacatggtgtttggttatattattatctgtaattttggcaaatagtttataatttgaagcatatttagcagttactgtaataaataaattagttattaaaaaccaagaatttagcactgagtttgttccactacaagtgctcagcaaacagactacactatcacatttttatgttagaaaacctatctttagactaagaaatatacgcgagaatttctaaaacaaataacgttcaccttttgaaactaaaaataaccccttttgtggacaatcaatgtcaaatgtgaagtcattatgaactaagtgcaaaaactgagtgaaaggaatttgcagactttaagaaactgctaaaaatagcaaaaactaagtggcagaaggaatttacatttctttaggaaacctaaaggaatgtaaaagtatttgaaaagaaaatgtttagaatgaacatgtgcgtttattatacattcatatccaaaattgagggtttcagttataaaatggctgtgggaaaacaatcaacagacttctaagcatgtaattttataataatattttttaaaatttaaactgataattttatgcctttgtatgaaagcagaaattaaataaatgtaatttaaaagcattcagccattttttttttctttttaccttcaatgactggcaaagcaaatgtttctgattttgccaaaaatgctatctatagatgatgaagaggccagttattgctttgaaaaaagggtctatttcaagccacctctgtcatggaattttgctgttttcaatctgtttcatctcctctgggaactccttcctacatcactttctaactgtaaaataaatgatccaaatacaatttttaaatccccatgttctattataatttctgaaaaccagtctttcaggtataaatggaaatctgtcttctgttcattatatgactttagatatttttaaaatattgttctttatccagcacttatagcctgtaatttaagactactttgcttatcattatttcatcagggtaatgttagtgattgtgtatttttattttaacaatttaaatttccactgtttggatgtaaaatgacagcattctgactcatcggtctttgaaccgataagtttcactattcacacataaaacaggaaagaaaagaagaagacaaaaaaattactagtggatatatgccaggaccaccttttcttgtttcagcactggatgttttggacagaggctcttagaggaaatcttcccagaaattaaattcctatttttgcccattctggtgtgtaggaagagttcaatggaaattgtgaaacacaaaatgtaagaggttacatatgcaggcttctgaacaggggcaattttgaacagaatactgcagggttgaagttggactctggagaatttaccattgacctgaaaatgtaaggggccatgggaccacataacatcatgccagctgcttcaaagaggtgcctgccatttaggtcattttcaaaatcatcatttgagaggactgtgaaattgtttcagtgaattatataaaattgtttcctgtaatctttcaaaatgtattttatgtaaattggcacatttaaatagccttctataatatcttaaatagcaaagcctttggaaactaatttgccttaattgaaataggtgcacctgttcattcaaaagcaaatttacctcattacatgctagaaaaaagacactatctccaccttgaagccccacctcgaagacccacctcctccatggaatctagacctaaaaagtacttctcaattaggagaaaaatcttggaagtaatttgcacctaagtcactagtgcaaaaacagaagaccacatgcttttggacaatgatagctttgaatttcactgtttcttaaagttcccccatatttctagaaagctttcctaataaaatgcccatattttgtataaatatcctataggtaaattttgtagtgttttctcttgatttatataactttaaataactacttgtcggcctatgcatataggccgatatataatagttaagagactagcttttagacttggaattttactcagctgtaccacttatcacctgtggaacttgagtacatcatttcctctcactgtgcctcaattagttctactataaaaaatataatagatgcacctgccttgtaatttcttgtgatgatttaaaaagatgtctttatagaatttaacataatgcttagtacacgtaacacttcataagtattaagatattttctctgaggcattaagtgatttaagtattttgaagtttaaatttatacacatttaaaaaataaaagactctttcttggttgtaagtactcatttgaatgaaaatatttcttgcagtgatttaaaaatatttctttagtaaaattaattttgcataattgtttgttaaataattaattgttaaatatttcatgactgcttcaaaaattttcatattcctaataaggtactgttcaccaaattaaaaacaattcttggctaaacacatagcaatagaaaaaactatagactaaatatttatcaatgcactacacagtgaagcataagtcattttaattttaaggatggatttttaagtaatgatccttccagttcaacaaatgataactaatgtttttattttaagtattcttaaacaaaatatatatcagtatataaattttaagtggttatacaaaacatacactatttacaaacctgactgataatattaatgaaaagaccacccactttattgtattaactaataaacatcctaacgtcaaatgtaaaccaacattgaaaaagaaatgtaaaccaccataaaaattagttcattgaaggagggaattatattataaagtttgttgaaaaatattctatatttattaacattaatgttaaatgttaataaatatagaatatgtttataatatatatagaatatgtttataatatataaatatagaatatatttataatatataaatacagaataaatattataaatatagcatattttccaacaaacgttataatataatctctttttaacatttctatgttaaatttgagatgttttacaaatcaataaaatatagacgaatccagaatttattcaatgtttcctgaaagataatttatgtcttttagtgttcatgtaatttatgaatgttcaaaataaaaagtttgaaaagaaaatatacctttcttcacttgattaaaaaaggccccaaataataatataaattcagattctgaacagaataatcataaaaatagttatatattaactattgtaggataactgcttttctccagtaaagccatccttagaaaatcatatcaattcttcacaatttatttttagcatattttattccttagtgattatttgaaaatcacccacgttttcaattcccatcatatataattacaaattgggtttaaaatatatttatatatctttataagctacagaagcagaaagcagaagatgaacagaatatgtcttgcaaatgagagatattgtggtacattcttcagttgctgaataaaggtttaatggttgtgatggtgataataatttaaacaaactgaacaaactgtcctcttgaaagaataagatgctaatacagctaacaagggaagtgaaagacctcttcaaggagaagtacaaaccactgataaaaaattcagagaggacacaagcaaatggaaaagcatttcatgctcatggataggaagaatcaatatcatgaaaatggccatactgcccaaagtaattgatagattcaatgctatttccattaaactaccattggtattcttcacagcattagaaaaacttttaaaaaattcatatggaatcaaaaaagagcccagatagccaagacaatcctaagcaaaaagcacaaagctggaggcatcacactacctgatttcaaactatactacaagtcaacagtaaccaaaacagcaggatactggtacaagaagagacacatagaccaatggaacagaacagagaacccaggaataaagccacacacctacaaccatctgacttttgacaaacctgacaaaaataaacaatagagaaaggactccctatttaataaatggtgctgggagaactggctagccacatgcagaaaattgaaacttgaccctttccttacatcatatgcaaaaattaactcaagatggattaaagatttaaatgtaaaactcaaaactacaaaaatcctagaagataatctaggcaataccattgaggacacaggcataggcaaagatttcatgacgaagacgccaaaagcgattgcaacaaaagcaaagattgacgaatgggatctaattaaactaaagagcttcttcacagcaaaagaaactatcatcggagttaacagacaacctacagaatgggagaaaacttctgcaatctatccatctgacaaaagtctaatatccagagtctacaaggaacttaaatttacaagaaaaaaaaatcccattaaaaagtgggcaaagaacatgaacagagactctttatccagtctatcattgatgggcaatgattttataatataatgatttatattcctttgggtatatacccagtaatgggattgcagggtcgaatggtatttctgcctctcaaaagaagacatacatgcagctgacaaacatatgaaataaaagctcaatatcactgatcattagagaaatgcaaaatcaaaaccacaatgagataccatcttattccaatcagaatggctattattaagaagtcaaaaaacaacacatgctggtggtgttgtggagaaaaaggaaccctttacactgtttgtgggagtattaattagtttaaccattctgaaagacagtgtggtgattccccaaatacctagaggcagaaataccacttgaccctgcaatcccattactgggtatatacccaaaggaatataaatcattatattacaaaatcattgcccatcaatgatagactggataaagagaatgtggtacatatacactatggaaaactatgtagccataaaaaggaacgagatcatgtcctttgtagggacatggatggagctggaagccatcatcctgagcaaactaatgcaggagcagaaaagcaaacactgcatgttctcacttataagtgggagctgaatgatgagaacacatgcacacatgggagggaacaacacacactggggcctgttgtggggggagcgtatgagggtagggaacgcatcggaagaatagttaatggatgctgggtttaatacctatgtgataggatgatctgtgcagcaaaccaccatggcacacatttacctacgtaacaaacctacacatcctgcacatgaacccctgaacttaaaagttgaagaaaagaaaaaagaaaatcaaagaataagatgctagacctcggcaaatggtgggaacaaaccacagattgaaatcgagagaggaaggttttgagatcattaaagaaataaaataaaacaaggtaagtaataagttgacacttgcaagtctaaatgccaggctaataggcattatggctatagaatatatataactatatattcgatatatcgaatatatataactatatattcgatatatcgaatatatataactatatattcgatatatcgaatatatataactattcgatatatagaatatatataactatatattatatattctatatattctatacatatattctatatatatattctatatatagaatatataactatatatagaagttatatatatagaatatatataactatatataactatatattctatatatagaatatatatctatatatagaatatataactatatatagaatatatatatagaatatatataactatatattctctatatagagtatatatctatatagagtatatataactatatttataaataaatatatataactatatatttatatatagttatatatattctatatatagttatatataactatatatttatatatagttatatatattctatatatagttatatatatattctatatagagtatatagagtatatataactatatattctatatatagagagtatatataactatatattctatatatagagagtatatataactatatatagaacatatgtaactatatattctatatatagagagagaatacatataactatatatatatttgatcaaatctagccttccctaataactggaatactcacattattttctagatgtggctccaaataacttattttagatttgccatcgtcatttatactattcagaagaaaacactgccacaggtcatggagacattttcaaaagtaaatattccaaaaacgtcctaagcaaagacaaaaatcacatttgtccgaagttcaggtgatttttgtttcattgcaccttaaacagttttatatatgtagaacctcaattaacacgtttattacaataaataacgttcaaggaatgaatagcaagtactcaacaaaagtttgttgtataacgttatcatcgattagttaaccaggttaagagctttctggatttgaaagttaaaccaaaaagaggaatataaagtatctttagatttacattcttaattcatcaattatttttatcaatgtaattaattgttcattgtccaatatctcttatgtattgtttgttgccacatggaagagtccaggtatttatttttaaaccaaatgctccattttggtaggctttcttagtagatcggaaagttatacaacacagggaagattatgtttgttacatttaaatcctaacattgcagcatggaaacatttttagtgtacggaacaggaaaaaaatgtttgtgctaattcctgctgatttaattgttggaataatgacggggtttatgtcaatcactctagtgcccagggctgtgtgagctggacaatcaacattgatgaaaattatattggaacattccacaggcacattaaaacccgaacatttcaggccagagagtccacttagggggttgatttatctggtttggtttatttttagtgtcatagcaattgggaaactgtcagatagctactgaattatgctttgtatgtgatgtctcagaccgtcagatcttaattttaaacggagtacacacacacagtgtctctttcatcctaaaacacattattctatggataataaaaaaagataaaatgtaaccttcacttgaaaaaccattacatgtatattgcaaattgaaatgtttggtgcaactgttactgattgtactgttcattagaaaaaagaaaatctgaattgcaaccaagatctacataaaggaaaggaaaggtgaactagagagattcacattatacagtttcttgacatgtaaccagattttggaagaaaagttataaatgatacattattaaagtaagtctcctaattaagttgtttttttctcctcctccttcttcatgtatttaagcacataatttaagaggaaaatagcgatatgcagatcagaaatattaattcaaaccctagttcctctgttttttgtttgcttgttaattttttgtttgatttattttagattcaggggccacatgtgcaggtgggttacaaaggtgtattgtttcaggcttcaatttggcttctacaacccttgttctcctccctctttccccccattttggagtccccagtgtctactgtttccatctttatgtgcttacatgaccactgtttagctcccgtataagtgagaacatgaagtatttgattttctgtttctgtgttaattcacttaggaaaacggcctccagcagagtccatgttgctgcaaagcacatcatttcatccttttacggacgcatagtattccatggtgtgtatgtaccacattttctgtatccagtcccccgctgataggaacttaggctgattccatgactttgctattaaaaatagtgctgcgataaacatgagtgcagatgtctgtttgacaggatgtttcttttcctcttatatagtaccacccgcataccagtaatggggttgctgggtcaaactgtagttctatttttagttctttgagaaattttcatattgttttccttaggattgaactaatttacattctcactaaaactgtgtaaatgttctttactttttcatccaccctcaaataattattaattatcattctgattctcagctttcttaagcttaaatgtgtttcataataactctcttgaaggctgttctaaagatgaaaatgcttaatatgtttcaaaatggcatatcaccatctttatacattttcttaacactaacttgtaagttgtaaaattgcaaaagtcagacctaatcttaattttattcaaattcccccatgattgttggtgtaagtcttgtttatgatgatgtgaaaagccaaacattgaatttattcaacaaaaatttatatggcaagaactcagtcaggtgctggagaagacaagtggatgtctcctaagttgagacagtagtcattctgatattacggaaatattacaatgataagcaactgagtttagcgaactacagaagcgagcccaagtgggtgctgcatcaaaggaaccggaagaagcagatactgaaggccagaaatactcagtaagggactggctgcccaggaaagtgagaagcacaagaacagatcaagtgagagagtcaaaaggtagacctgggcaaacacctgtattgagcagtgctggcaattctcctagcacattctcaacttcttgtgtcctgtgataggccatctgcattcaaataactgaagaaatagtagatgatagaagcttgtttccaaactatctattttcatatttaaaaaaatgctaaaaatatttgggacaaaaaaatctgtaataaagtgtgtatggaggtatttgatatgccctgttaattaataaaaactgaaataatgtccaataaaaattgtacaatagaatcataaagtaagcataaatgattaaaactcttgtcatgacaactgactagagacgggatgtaccatgcacaattatgtagtcaccggatataaataatgtataatatatgtaaacaacattggtgaaaaacagcatataataatataatctgtataaaacaatatattataccgatatataaatatataaattatgaaatatataatattatagatagatatagatatatatgtctgatgctccaggatagcagataattggcttaaatctctccagcagcagtggcatgttattttatatttcagcttctactgttttattcatatggatataaatgtatgtaggcatttaatagtatatgttattctgtgattttaaaatatttattctgcaagctaaataaaaatcacctttctaacctcttcataatacctcagcaatgtaaatgtgaaacaaatattgtttctgtcctatgaccccaatcttgtgtggactccatatttaagtccacacaaatttatcaatattttcatttccaaaaatgttggtcatcattccaaaagggaacaatagccacaattcccagaaacatttgttactagatttttaaagattagctatccattctcaaattcattacctgactcaaaattttcatgtttacagcattagtaaaatttgaatgtagtaaaaatcccattctaaggaaaaaaatgtcactttatgttgaaaatgtttgatggtgattaaccctggattctcatttatatgaatccattgactctgtctggctatgaagtcaccagatcaaattatttcaatgaactaaattatacaataccagtctccaatttataaacataatttattactaagctatgagtaagaatatacagagtgctcagaacatctagagaattcagggcagcaggtacacaatttaaaaagaaaaaaaaaacctattttcttagaaatgctcaagtgtccagggctaacttttccttctgaaatatcaaggttcttttctgaatggaaaagtaactctccattccgtttataaccgagggttcaagtgggaggcaatgtagtaggcctatagctacaaagttcagtaggcaaggcctgttcctgtatagccttaggatgaaagatggcatttagcagaggagattttggcatctccatcccaatatttttataaagtcattgatgaagaaaaagatatcaacacgtttattataatagtaacaattattagtatgtttattattgttgaccagggtctgtgctagtttttaaaaaatacattatcatctctcctataatacttcagtgtagataatattaatttgttttataaatgaagaagctgaggcttagagagaggttaaatagctgacaaaaggtatgcagccagtaagtaggaaagagaagactgactcaagcccatatgcttatgatttttgcactaattacaaagcctgtgttacttacaccatattacattatttctacgctaattccaaaatcccctaacttttacaagccctagttgtagtgcagccttgataactgggtcccagccttaccttttctgtctgaattctccagacaaccagctttttactggtccacaatagagactgtcctacgtgctagtaactgaccaaggtttcaaggacaggaagtcctgaatcaaacatctcagccacttatccttagggacttccaagctttacccttttcttgaatcccttgggaggctttatcaattcctttataagtcatccagttgataattacttgcctgaatatctactggtgctaccatcactatatcaatgattataaaacttttgttaaaaatgcatatatgtaatttcttttttgttaaaaaaattttcaactcccaggtccatctcctgaattatttgttcatcatttgacaatcaggcattccatgtgattagatctcgggaacactcattcaacagcgcacactgtgctgcgtgttccacctgaacctgccaggaaccgaggatttatctgccttcactgcctgactagagaaatagccagatagagttccaggaactgtcactagaaagtgtccccaactaatggggcacacatcctggcctaccaacaattcatgggaaaagtccaggtactttaggtatttacaggttcatctgaagccaaaaatgtgatgtcctgctaacactatactgggacctgcttgggtctgtcctgagaagatcacagatggagtattatgtccagttgtaattgtcacattttaagacagaggggaatgatcagatggggatgacagcaacagtgagaatatggaaagtcaggctgtataaagtgtggttcagagaacaagagagatgtagcatgggaaacataagcctgaagaaagagatatctttttgcaaataatggctgtggacatatggaagacttcttttctattactgagaggacagagccagtaccagtgtacaagggcaaaattttaattcagtttaagaaatagttttctaagacctagggcttcccaataatgtaatgtaaaggagtgaagtcaacataaaacagaagtcaagtaatttgtgaggtatgccaagaaagataccaggccagggacagtgaagaaaacattagtactagaagataataccacagagcattttctatttattagtcaccatttgttttcatcattttcaaaaatgagacaagcaaggtgtctctgtgacacacaaaaaataccttatcctcaccttgcctcagtctgtgctacctttctgctctctgcttatatatatgattggtccaggtccaggggtagagaaaattaactcatgctaggccaataatgtccacctttatgagaattctaaacttatttttaagaaaacacagagctgggcattctctggaaatgaacaaatgatatgtcagagagaaagatgtgaaatcccactgatgtccaggagccaccagcaaccttccagagccttggctatgcagtttttatttggtgttctgcactatcattgcattaatttttaaaggaaaaaagccctcttaatttagtagtttgtgagcaccagtttccattatttgctgaataataatatacttttaaaaacctcttcctcttccttataattcctatattttattgatgtgtcttctctcttggtacttacattttggaaagttgtgcaaattagggtatatgtgataacaccaaatgctaaacagccttttgattggttgatgctgtggtttctagtatgagtaaagcaaccaagagaaagttgattgccatattaaattcacaatagcacacaaacaatatcaaacccctactaaaattccaagcaaccactaaatttatcaaaggtcgccatccatcagttattcatataaagccagtaaaataaggcagatgccagatgttgatgaactcctgtttgctgaatttattaaccagatgcagaaatttactcattgcttgagtgcttcgatatcacagagatatgcactttaagaatatgcagatagggagattaaatagcatcacttgactgtgcgtctgccgcatagcaatgcataatgaataagtagtatgcttttgcttcatgtttcctatttacataattcaaagctttgacatcatggaaatatatcatgggattgtatcctgttacatcatgcataaaatctaacagtgtagttatataagctatgaaaacagaagcatagggaaatgagatgcacttaaacactaatcaagataaatgcaaattgaaggcatgaactgaatatgttcttcttcaccaggactatgtattacaataaactaatttgagttattcatacataaatgatgatcccaatcttattttgaataattaataatgagtaaacataaaggcagaaataaattagataaaaacaaatcccttttaaaaaaaagaaatagcacagtctttattcaaaaactctaaggactgtgactgcaaaccctgggtcagaaggtaagattaggcttcttaagtgcaccatgtaaataacaatcaagtttcaaggctgggcgtggtcctcacacctgcaatcccagtactttgggaggccaagctggaggactgcttgagcctaggagttcaagaccatcctgggcaatacagcgagacccccatctctacaaaaaatttaaaaattagccaggctcattagccatgagcttgtagtcccagctactcaggacactgaggcaggaggatcccttgagcccaggttcaaggctgcagtgagctacaattgtgccactgcactctatcctgggcaacagagccagaccctgtctcaaaaacaaatgaacaaaaatcaagttctctttcattaagcatcttataaggagggaagacaaatgagggtcaggaaataggaggaagctggcttggggcaaataataattactttgctaattacaaactgaaagttcagcctaagatttttaaaaatattatttaaaatttaaatattaaaatatataaaaatttcatttaaacaaatttttagaacaattcctttgggattagcaagggcttttaaaatataccttgaggcattcaatatgtatataaaaactttgggaattttacactatgccaagactgcagcaaactggttttgtgtggaccccacataggcccattattaggtgacgacatacatacaatttattttaaaacaaaatttttctatgttttagaatcaactcacagataactgttgaagtgaagaatgattactttaccataataaacaacaaagcaaactgacatagaatgacacagaggagggttctagaataaacagagatatcaatccaaatttgagctttgcagggttatacactataaaatctgctatacttgtggctcttatccaacctcattaaagtttcagtttcttcaactatgaaacaagaacaataatatccatatcaccagatatggcttgtgaattaaacaaatagtagtgtctggatatttcaagtagtacgtatacagcataaatatagaaacgaagaaaagaaggaaagaggaaaggaaagaaggaagaaagaaagggaggaagattgcttaatttggcattaatatacacataagaatataataggtattaaactgcactttttacaattaagactttcaggaaaacaactttccagaataaacccctatttctgatagtaatcagaaatgctctgtgagcactgtcgcatattttaattataagcttttgctaaaactctttaccaaagtaaagtgatatgaactttaaaagaagtttctgaatatatttaaatattttattgatatagtctacccacaaaatttaaaaaagtcatatacttttacaaaattcttctaaaaattacttgaagatttatgatgaatgagtataaaatatttaactacaaaagactgttggaataaaaccatatggaatataaaataaaaatttatgtaaatgatgggtaaacatatataacaagattaaaaggtcatattattcttgaaagaagaagtttataatgcaagtcaataatgcaataatctcaacctaaacttagataatgctaacaaagactgagagtgaatggaagctagagctgaaattagaagctgagtatagacttggtctcaaatagggaagactcaaagatgttgagtccttttggcctaacaatgaatacaggagaatggatgttgatggaaaccttaaaaacactcaagtcctctccctccactgacaattaaaagcttggaaaatataaaaaacaaactcaaagaaaagattgaaccaactattaaacttcttttaaacagaaaagagatgttatagtgttggaaaaaatcaatttgagattatttattcacaaatacttcgatatgctcctttcattccaagttatttaatattttttattgttttaaatgtcaaattttgtgtattttttagcacactataaaatgtgtactttatttacccataaaatgattttcattacctaaaattaggctctcagaataaaaatattttctttattctgtcatctattagtgtatatatttaattatagccacaaagttcaattacttaagaatttcttaccttgaatgtgaggtacatatgtatacaaaaatatttatagaatataaaattttcaagaacataaaaaataaaatcttagaaagtggtcaaatatataccaaaaatccaattgtgagtcattaaatatgaaaactgaaattgagatagtatgtcactccctcttgttatacagaagagaatttggcggagtctcttacatgatttttttctttgtaataacatagttaagtagcagaagcaaaaataaactccagaacccctacttaactgtcccaccatgtactatattctataacatattgtgtctcttcatctttgaaaaaaacctgttagctttacactgaattactgaaaattacagtgtaaacatttattaaaaaattatgccaaaatgcagtattaaaaaaatagatcggtaaacaatcttcaattcatggaaaatttgaaagaactagagattttttttatttctaaaattaaattttcagcaaaatccaaaaggaaaataaatattgaacatttttaaattaatccttacaggagtcataacactgggtacatgcagaaaggttcattattactccgatctctgaaactaaatgtaaagcagttgttcagataaatgaagaccacagcccttactgtgttgtgacatatcagtaattatgactatgtggatttatcaaactcacatattagtgataatcaaattagatttttataaaactacatgatgattacaagaataacctaaaacaaaactatatttgttttgaaagtttaaaatagagactgaagaaaatatactatatagatactaacttgaaaaaaatttatatatgtagtaatactaatgccagtaagaaaaaaatgtaaaacaatgcatcaaagggttcacaatacagtaaaagacgtagagtccactgagaagccatttcaattataaacctaacattactacctttagatttctaaaggacttgcatacctaaacccttcaggggaagcaggaatttagtaaaatagaaaagatctaacataaatttaacaagtttcttctcataggtatacatataaaatcctgtctggattgacatctttttcagatacacaaaaactatttatgaaaactgaccaccagctgggttccaaaagatcacaaacaatttcaaagaattggtatcttacagaaccaatgtttttttaccatgatgttacaatagaaatcgttaattaatagatactgcaaaaactttctgcaaaaaatttctatacgtttgaaaacttcagtagcccatgggttataacaggaaatcccaataggacaaaaagaaaaaaaagaaagagaaccagaactttacaataaaaggaatacttttccaaacttgtgggaagaagttaaaagagaaatggatacatttatttaataaatgaaatacatttattaaaaactataagactgagaataataaatttaaggtaattcaactcaagaagttagaaaaagaatgaaaatgtacttaaacaatctaaaaggaaggatttaatcaaagcaacagtataaaatagtgaaatataaacacagaaatagagagagccaaaaaaccaaacaaaattctttgaagagactaaagagtaaacaaacagtcttccaagaatgaaagagaaaacttacaaagaattttagaattgaaacgcgaatagctctttatagaatggatggcaaaaatcataagggactactgtcagtattttcatacaaataaatttgaaaattcaaggcatttcaaccacataattgacaaaggattaatagaatgatcaaagaattcctacaaactaaaaagaccaccattctttttataaggaaacatcaaaatgttcactacagtactaattgcagcagcaaaatgtttgaagaaaatggaatatcctttaccagagaattgctaacccatgggtcatacaacagatttctacatatatattaaagctataggcatcaacaaggcttaatccctaaaataaaacataaacaaaaacagaaaataacatgttgaagaatgtatgttcagcacaacataatttacaaaaagttggatagatcaatgatatgtgtaaacgtaaaaaaaaagcataaaaatataaatactaaattcagaatattggttaacttggtggaggaaggggaatgagatttctgaaggcttatatgggggtcttcaatttacctgtaagtttttttctcataacaatatctggaaacataaggcaaaatgaaagaatttgatagagccccaccatgggtccctgaggcttttaggtctctgtcctcctctgtatatttggaatatgtcataaagaaaaaaaaaataaatggataaatttcatatttctttgtttttataaaatataagattaaacccaatttagcttacattctgaaaaattcagtatacaagtcttaccaaaatgtaatagttatttttttaattttccatgaaattgcgttaaaatttttgagctgtatcttttctgtgataaatactccagtatcctcaatattaaattgaaggccttcatggagttaatgaagttctttacgattttaaagccctaaacaagtggaaaatggcagacaggctgccccggatcctgaaaggtgctaggaaacagagggcacaatttatatggaaaataaaggcctcaagagtcactcttcctccagtcttgagatgacttttacatagctcatattggcactccgaatggcctgctgactttctacaatctgagtgtaatagagacaacaacttttgactccaaacgttctaaggttactgccaacaaaactactcttcagtgttcagtaggagcacaatgcctgtaggatgaagggataagatgcaaagagaatcacttccttctcttcactattaaaacggaaatgtctttgagtgagtctttagtcaattcagtagtgacgcaaagatgaagacatcctctgattaaaatttcccatgtaagatgtaaatgtgcacatgtacatgataatgtaagttatatcacacaaaactaagaaataataacttacacacaaatctaagttacatcacacataactaagaaataggactttcccatgttagaattagaacttggctaataaaatcaggggggctatagggaaagagcctagacttccaagaccactggctaggacacttggtagcaagatttgtggcccagttgctatttgtgaagtctgcttcctcatttgataacaacagtacctataatcagatgttattttaaggaccaaaactatagaatatgttcaataaataattgttagaatttattgatggagggtagaaactaaatgcatggaaacaggtgcacaactgctagttgtcattgacagcaattaactaaaacctacaaggaggagaaattttgccccgcctctcctacctctagcctgatcctgctgaaacagtcagtgacaggcagctgctgtggcattcttaagggctggtgaatggtagtgctgactaaaaatcaaacagcaaattgtttattattgttttgctttgggtctattttggggagggccaggaaatggcagagggtgtgaaggaatgatgtagagtccacaggatgaaacactcaagtgccaattccttatgtacaggcttaagaagagagaagccagcaactgcaccttatggaattgattagctgtgtgaattcctcacgcatgagtccatggcagctggagtaacagtatgaaactgctcagcaggcagctcttttggtcactggcagctacgatgaccctttcatagggatgatttgtttatttctgtgccccaaagaatctttgcaaacataaagacatacagaagggagaatatgagatagaatattattttaccaaagttttaggaaattgagagttagaacagttttataactcctccctcatgaatgatgtggagaagtttaccatttaatagtccactaaagtgcttttattcctgcatacatgaattgttttaaaatatttctatttaaggcacagaaaatgcaaattaaaatgcataagacaataacaaggacaatttttactctcaattaatagtcaatcttttaactgttatgacttactcatcataaatatagcatatacttgccagtttgatacagaaatactcagaaatctacaaattgactaggattatgtggtttaatttatgtcttttggatatctgatttcttttagcactattatttgctaacaaagccaaataaaattgcatgtactatgttgcagactacaacgtcctttcgcctaggttattcaaattaatacttacaatgaactcatgagggaagtcagaatattattactgtaaccatattccagatgatgaacataaagcaaagagaaattaaaagttatctgaggttaaatagagagtaattaggcagaattccaacttagttttgcttactcgaatttcgaattctttcaatggtcaaaacacagcatttatcactgcagtgacatacggacagtggaaatactgctatgacctttaaaacataggtcttaacttgttttttttttttttacttgaggtgactttacctctgtgtttattaggtagctcattagtttctcattgctgctggtgtaaagtactacaagtttagttgcttaaaacattagaaatgcatttttttttacagctttgcaggtgaaatgtccaaaatggttttcactgggctacgatcaaggtgtctggcaaagcctgtaaggggctctggagaagaatacactttcttcccttttctagcttctagaagctccatgctctccttggctcatggcttccttccacattcaaagccatcaatgaccagatgagtctttttcacatcacaccattctgaatctgactccacatcctctctctttcacttataaagagcctgtaaagacactggaaccatgtagataatccaggatcataatctttccatctcaagatccttaatttaaccacacctgcaaaaccccttctgccatgtaggtaacaagtccacaggttccagggagtaggttgtggacatctttgggggccattattctgcttaccacaggtagatttgagttatcaaaaaactatctatctataccagtgtgaagtgggatgaataaacataggaaaatatttaaaagtttcttaggatatccactgataagtcctaaagagaactgttatatattacataaaaatataactttctcaaatatacctacaattcctgaaaatacagattgtcacagggtctgcaccaacatatacattcaaatagaaacccatgaacttaagagcattgtctgtatattctatctgtcctattacaggtaagtaatttctatatttcacagttttcatgtagttactttcatctgttggttccaattcgtatagatgtatacattcagaaatgcatgcagattaccatgcatatatgagtagtttagaagaccttgttaatagcctgcgagctgtccatggtctcagtatttcagtagataccagtccaactttcaactgttatcatctccactttattccctgagtttttgctcttactgccagaacccatgctgcccacttacagcagacaggagacaagtaattatgctccccagagcagccctaagccaaagtttaacaagactttttgtataaatacccagctcccttgcatcttggtcaggataagtctgagttgtgtgttctacactgtttcatagagtcccctgtagaattaaactccagatacccataacgatagctcgcttgataacataccatttattgggtcctctcccatcctgtctcattttaccattttcctgccaaagtgccctgggattgcctcccagatagactccttgcctcaattccctgtctcaaagtctacttctagggaaacccaaattaaaacactcagaaatatttgcagataattgttatcatccattgacatgctaggtaaatactaaactatcatacatccataatcctactgatacacatatttgtattcatatcactatgaatattcaacccatacgttaatttctctatgatgaatgtattaccacattactgtacagccagtcagatatttttaggttgatgactcatctaaacagctgaataatgtatcaggttaagtaatgcattatttactgtaatgcattgtcaacgcattacagtaatgatttattatatgaatgctatattcctatgccagagattattttatagatatattagttgatatagtaagttaagagaataatttggtacatgggagggagcataatgtgatgtagacatcaaagactataggtaaagttctaaggtctgaaacacatgagctcaaattctgactctgccactgaaataactggataaccctgggcttatctcccacattcatgactttttaaatctattaagtgataataacaatataaatttataatattctgagattagaggagatactattttcttatttaataaaatgtactaaatgcttataagctattttttgaatgtcaaaaattagtctaggttctgggcattcagctatgaacaaaacactttaaagcttctggaatttctactaaagaagtagaatcaattaaggaataaacaataaatgaagaaaatgaagtgttgatgacaataaactgagggtcatgatagaaactgggtggctactttagaacagataaggaagggtagattcccttaaggaattggtagctgggacctccacaaaaaagagccagtcatgcccatctagggaagaacattccaggctctttgaaaagaatgtgcttacatgttagacaagaaagagccgtagccttttgaaaagaacgggcatggcatgtgatggggatgaaaaaaacgtactccaattctgataggtcttatcatccatacagagtttggattttagtccagatatgatggaaagaagtcactgctaggttaagatgtagaaatgatattatctcatttacaatgaaacacaccctgatttcaagaagtagattagattttaagggtgtaaagcaagaaaaagataggacaattaggttctattgcaatcaccagagcaaaggatgatgacagcttagcctagaagaataacaggtgaaatggatggatttggaatatatttcagaggaagagaagctttttgacttcctaatagattgctggaaggtttaggcaactaggtaaaatgaaaaatcaaggatgtttgctagattggttatatgaattacatacaaagcactctgctcaattctggacatatattaaacactcagtagatggtagctagacaataatgcttggtggctagaaaagagaacttaaatgtagacggtaaaatgaggaataaatggacagagtatgttaacaggtgatggaaataagtattcattattaattattccttattcatacttttttttctaggcaccattcataatctagacctatataactaaacagtgaatgttaggggccataaaggaacacacatgtgtacttgtcttcaattccatttcaattacatgccaattgaatggaataagcaataataaacacacaagaattagaagacaaaggtccctagatctgtgataaaagcttataatatcaatatgagaacaacattatccacctcttctaatctaagtcatgccactgtatgcacagagcataaaactataatgggtaatttgatctgttaacaacgatttcaataatagaaagcaagactcatactgctaacacaataatattggtacagtcatagataatcaaattctaaaataattctaaatatgtattaccagggctaaaaaactttaaagaacatcagcaaaaaaaaaaaagtgctcttcattaacaatttttgtgattattcaccaccttgggtttaacttttaaattctctttcttctagttgaacataccgtctgctagttttctccattgtctttttcaggttccaattctttctcacagatttaattctcatataattatccttatgtttaaagagaaatagtcctctttaatctacctgaaattataattaacctaattaaagatttggtgtcctaaaggaaaatttatattcagggaaagtatagatttaccatgttttgggggaatattattccattatatttaatatactgcctttgacttaatccccataaaagtaaaaacacaactccactggacagatcctgaatctgaaatttcatatttcataaatctgaaattatgtattctacttctcaacactttcttttgtaaattactcattcattcaataatatacattctttattacttggttatgtgtgaaaattctttgtatttttaacccttaggagagaagttatttagacatagtcttattagagtgagaaataagacatattgacaaacaagttgttagtagaagaaagcaaagattggttaccagcagcaaacaatattctatcatatatgtgaggacaaatatttcctcagttttgaagaacaaataagttaattgcctcagtttttcttaataaagtttattcataatcattgtgaggtttgccacacttcagtcacctcaccgatctaccaaatgaatatctagaagtttaatttctttcccagtagtaaattcatatttagatgaacaagtaccaagcatcaatcataccagacacttcccagagctaggacatgcacattttttaatcttggcagctggtgctagaaaacctccgtcttactgactagaactgaattaaatgtggttatcaatctcgattgttgtcagggaggatgtaaggtacattaataagtagcttcccaaatcgacagctttctgacttgctgcatttcttgctctgagtaacctatctccagaaagtgggctcctcttctaaccctagtgattactttagtttgtgtcctgtatgcaaagtctgatacttttccatgatgtctacctctggccccacattgcattcaaataccagtcgtcatttacatccatgctgtcaatgctttttctcctcagatgcccaggttctagccctttcctgtactcataccatcacatggccattgtaaacaacaaaaccctggtttctttcatgttatttagcttccagtggcatttgctcagctgtatccttggcattgcaagctcatcccactgccatccagggccagtgatagcagccacgattactcatctaaaagttcattgttagcaaattatattttaaatgccctaagagagtttcccattgaaaagactgagactttctgaaaagctaagaaactaaaataataccttactgaagtaaaaactcaaaaactatactttttattgaactttggaactgtcaggataaattttcttttcttcaacttatgtttagaaattaaatgtaatagactaccctttggaaagacttcttagacctgccaatttgggggttgagcccatatatttgggacagtggggggaaaaaaggtactttgttcaaccataaaaaagaaggaaatccggccatttgcaaaaagatgaataaaactaaagggcattatgcttagcaatataagccaggcacaaaaagacaaatatgcatgatcacgcttaaatgtagaaatttaaaaaaatcaaatgatagaagcagagagtagaatggtggataccaggggctcggggactggtggggtggtcaacggggagatgttgtgtacagggtacagtttcaattagacagaagggataatttctgaagatgtaatatactcatggtgactatggtaaataataatagagtagatttcaaacattctcatcacaaaaaatgataagtatgtgagatgataatgtgctaatcagtttgatttaatcattccacaatgtacttcaatcaaaacgtcacagtgtacaccatgcatatagccgagttttcatttctcatttttaaaaagtaaaaaaaaataaaataatttaagtcttctatctccaaatacatcactagaacaagacatgctttttggagaggagagatgcagcaattggtttatatcgcatttgccagtgaaataaatttaattattgggactgtttgaataaaatatattaaaatatttttaaaaatttaaaatgttaacatggtatcattgacgaaggcatagcttccaaatttagagaaaatatgtaaagaaataagtgtttttacacagaaaaaattaaaaatagttaataacaaggaggacataaaacaaataagtcgaaatgaggtaatgcagttttaaaatcatattcttgagggatagatcaggagatgaaaaatagcgtattttaagagatatttttaaagcaggctatgaaataataggttttattttctctgaatatagctttggaaaatatagagcaaagaatggtaagttttaatggtgatagtacagatatatattttaagatatttatgctttttagaaattacctacaaagatcttaaagttcttctgtaacttgaaaaacaattcaaaatataggccatttttaattgaattttatgcataggtttcaattaagatattaggcaataggcttttccctaatagctgctcccaaagaaaaaagaatttctctaggcaaagccatcttttagcggttggtagatttaatctgactcaagcctcgctaaaatatcttccaatgtttttaggttatactgtctatatattcttaataaatatttatcagccctgtaactgaagtttccccagagtagtaggtaagaaagaaatgtgatgagaattccactccacagcaagctttttctctttccttttcttatccaacactccccctcacatatctatgccagaattttttcatacgagctaaagctgttctctaaaacacagaatgaaagacttagccctttctctagccaatttttcccatgcatgtgatattgccaaagtcatatttattcccctcaaatactccattcattaataatatgctgactccaaaacaatgaattttttttaaagaaccgaagaaatgcgatattgagggagcttcaaatggcactgatcttagctggatgtattctaagcttatcatcactcactcgtggtactagcaatgattgtttcgcacatggcaaaatcatacataggtaggaaaaagaagtttatgatactgcaagtctggcccaatgggcaaagttcaaagatcccatgaatttgaagtgatttcctccacttcagaagtggaaggggaaaacgttctgtattttcttgtgattgatttaataaaagcaagtgaatatttaaaaaagtatatgattatagatcctatacaaaattgtcctaaaattgtgagaaaattaaattatacaattgatgtactcatatatttacctttacttgcaataccttttctctcaagtacattgagataatattcagtgtaagtatcagtgagaacttatttaagtcctcagcgaacattctaatataaatatccttagcctaggatcataagtataaaaatattgtgaatataaaatcataatattcaaactggttcataactatatgcccatgcaagttttctgaggagtaaataatgagttttatagatgctccctaaataaagaaacaaggaaactatgtcacagttttattaagattacaggaatttggaatgttgaatactacattaaggacaatagtgaatgaataaatcagcaaatacatgatttttaaaggtgctccctaaataaacaaggaaaacaatgtcgcagttttattaagattacagtaatttgtaatgttgaatactgcattaaggacaacagtgaacgaatgtgtgtgggcccacgtgtatgtgtcttctgtctctgattgtcagccagtttccctacattatacatgtgcctatgtaaccttggaaaaataaacatatacttaacacttttgttaactttattattataggacacagaaataataaaaaggaagtgctttcaggcagatggaagggatcagagaagagacgaaggcatggaatacaaaatgaaacagcagagagtgctagaattcagagttggaagaagccatcagcctggaagaaaatctggcccaagacagagaaaggtaagaaagcaattaagagtaagctcagatgtctctgacgtatcagttttctttagaatgcatttattctgtgccagcgaagctcagggaagaggtggaaatctgtttcaccccatacctatgactgaagaggctctgcctgcacagcggatactatggtagctgatgtcagatgtaggctcagaacatgaggcctgaaactcaccaggtcttagggacagttctaaaatttcttataaaaactgaatcagttatttcttggtatagtttgaatgtcccctccaaaactcatgttgaattctaattgccaatgtaagaatatggggggaggtggggcctttaagaggtgattaggtcatgaagcctttgcccagattggtgggtttaatgcctttacaaaagggctttcatgtatcatgggttctatctctttgctcttctgtccgtctgccatgtgaggagcaacattcctcccctccagaggacgcagccttcaaagcgccaccttagaagcagagacggggccctcaccaggctcctgacctgccagcaacttgatcttgaacgtttcaatctctagaactgtgaaaactagatttctatttttcatcatgtacccagttttaggtattctgtcacagcagcacaaatcagacttaagacatttctgtttctaacagttcggtagaagactctttctgaaaaagtgcatctatctatttatctacatacatgcacacatatgtacttccatatgtttaaacatatgtgtgtctgcatataaagatctattaagaaggtaaagtattcctaggggtgcaaaaataaagtgaaataattcagagagtattcaacactaagtcatattcaccctggaacagttgctccagctggtgaacctgggctttgaacttgacagtttaacaggcaacagagcccagagctctcttaaagagtctaatagtagttccctaagttaagctagaacaaatctatagtgtcctctcaatataagggcaaactagaaaaataactctgatctacagaaggagactgcaaggaaatttgcctgtctcaacatttgctctgggtaaaaggaagaaagaaatctcctccttgggatataatcaggagaaagctctcatcctagttgtggtctgaagtaacactatctgtgtggttcgagcagacttaagccaaaaatacctttgaaagtggtctctatttatagtgtccacaggtgcggagcacaagcaaacaaaaagctgctctagagaaattcatcttcaactaattcccaaatacaattccaaggaaaaaggaccaaaagtgaaagatcaaaaagcacgccatttctattaataataaatgcatatttgggagatattatacaacataatctcaccacattgaaaataagagaaaatgaaaaaaaactatagttaacatgaatgaatcacagagatgatattaagataaagcaagttataataatgcaagttgcaaagaggtgcatagaacatcattccaattacataaatttcaaaagcaaaaactcaatgaaatatttataaggaatacatatacataaaactcaatgggactggtagtattttatttttaacttgagtagcggtacactggcattcatttattgttatagatcttaagtatatgttatattctttcacgtaatcaatatttaatagaaatatcttcaaataatttggttcatattaacccactggaagtaaagtaaatattattactactttcagaaatgcatgatttaaccttacaggttccataaggtttctgtatcatttgagacatatttactaaatttactatgtgatggttattgtaatcagtactttaggtgaatattttccaattaatcctcctaagagtcctctaaaaaaaggtctttttttttctgattacaggtgataaaactaagttttcaatggaacggtatctcaaacatagtaagaggaatttaaaccaaaggcctatccaaacaaaaatgtgttcccttagtcactaagccatactaacggcacaataattatcaaggtagttgacttagcaacttccacttctgaccatgatggaatagcttgtgacaaaacaatgttcccactgagaacaactagaaaatatgagatgaaacgaaaagcaacaaacacctatttgaagatataaccatagagacagccaagctttcagttgccaagatcctgggcagaaacataaagtaagagaggtgagcagacattatgagagcaacattttcccttgggtaatataatatgatagtccttggataggtaagaggctgaaaatccaggcagaaaacaacagagttaacaaaagtgagactgccagcattttcacagagctggagagacaaaacattaaagtttgggcctttaaaggcagtcagatttgaggggctaagatcacggacagagggtacacaaaacaagagagaaatgaggttccctgatacttaaggttttccttttgaggcactaagttttcaaattatccatggtaagaagcaaagaagccaagcaaatatcttctgaaaagcacaagaatgtatgcaacagtctcatagtgcagaggttacaaaaattgaagttcagaacccaccaaagaaaaaaaatctcataaattcataggctctgaatgggtatcctgaaagacaactcccaaggaaagtgggtaggccataccagactgatacacacaggcttcagaaaagcttctagccatgtcatattctaatggaactggagtgatctgtctgccttttggctgattaccagaggatacactgaatcctctctagaaaggcaaaactgcatagtctagacagttataatttttaaataaaacatcaaacattcaatcaaaagttttcagcaaataagaaaaatatccacaaataagactaacaaaaaaatagaaaaaatagacaataaaaatgaaacttcagttgtgcttgatattaaaataggtattgtatactcaggaagctgaactgggaggatctcttgagcccagaaattcaagaccaccttcagcaacatagcaagactctgcctcaaaaaaaagaaataggtattgttaaagtactacaactagtatgtttgagaaaacagaaaggaagatgaagaatttgagcaaagaatagaatttattttacaaaacagaaatttgagaactgtaaaatgtaataactgaaaataggtctcaatatatggaattaataatattagagctaaagaaaggattagtgaactggaagacagatcagtagaaaacatccagagaaaactagaaaaaaaaaagcataatagacatagatgattggaaaagtgacatagagatatagagcagatactgcaaatgtttaatatatatttaactggaggatagagactataaagaaaaaggcatatttaaagaagtagttttctaggattttccaagataacaaaaagcatcaagctgtagattcaaaaattgctatgatcatcaaacagattaaacacaaagaaagctacatctaaaatactacaccataatagaactactgaaatccaaagacagaatttttttttttttttttttttttgaggcagagtctcgctctgtcgcccaggctggagtgcagtggcgtgatctcggctcactgtaacctccgcctcctgggttcacgccattctcctgcctcagcctcccgagtagctggactacaggtgcccgccaccacacccggctaatttttgtatttttagtagagacggggtttcaccgtgttagccaggatggtctcaatctcctgacctcgtgatccccctgccttggcctcccaaagtgctgggattacaggagtgagccaccgtgcccggccccaaagacagaattttaaatgctaacagtgaaaatcatttcttgttcaaagaagcaacaataagattgatagtggatgtaataaaaaacagagggtaatatggaaaaaaatctttagaatatagaaaataaatgccaacctagaatactatacacagaaaaaaaaagacaatgaaatgcaaaaacaaatatcctttgccatagcttccaaaatgtctcatacctaggtaccgaaaaggaagatatgcaaggtctctacacaaaaagaaaaacttaaaaatgattatataataggataaatgctataaggccaaaatagaaagcccattattgctaatatatcagttttccccaaatcaatttttagattcaatggaatctcaatatctatattcaaggtgatattaaagaacaaactgtaggtatttctgtcaaatattaaggtacaatgaagctgtgcatggtggctcacagctataatcccagcactttcagaggctgatgcaggaggatcaattgaacccaggagttcaaggccagtctgggcaacatagtgaagccttatctctacagaagaacacaaaaattagccaagtgtagtggtgagtacctgtagtcccaggtactcaggagactgaggtgggaggactgctggaccctgagagattgtggctgtggtgagccattattgcactattgcacttcagcctgtgtgacagaatgacactctgtctcaaaaaaaaaaaaaaaaacaaggaaaagaaaagatactatggaacttcagaatttcaggcagtgtgatactaatgccagagagcatacaatcgtaaaacagagtccagaaagaaaccgtatagagacatgatttatttacaagggtaatgctacagagcagcagagaaatatgctaggttacctagttatccaaattaaaaataactagtcttgatttctaccctccccactacacaaatatcaattccaggttgatcgtaaatataaatctgaaagtgaaaaagcaataaagcttctacaagactattttcataacattggatagacaaatgtttcttaaacaagacataaaaaatattaatcatagaggaaaaacaagaaaaaatcaccttacattaaaattaaagaaatctggccagtaaaaaaaaagaaagaaagaaagaaaaaagaccagtaagagatggaagaagatatctgcaatacacacagctttaaaaagcctggcaaccaaatcatgtaaaggaattgtagaaatctaaaaaaaaaaaaaaaaaaaaacaaccaaaaagaaaaatgaacaaaacacttaaacaggcattttataaaagaggatatccaaatgggcaacaagcttgtcaaaagatgtccaacttcatcagtttccatgaaaaggcaaaataaaaccacaatgggatgctattacatcaccaccacaatagctaaaataaaaaagactaacaatgccaagtatttggctgggatgtgaagaaaaaataggttggatattcattctcctcactctccctctgcctcaccacatttatggtgcctcaccatagtgagagaagtgtgtgcactctacagttagagcttctattgacagcccctctcctacagtgcccagcaatttccagggctgatagcactattcgctcaccttgcccctgcaggactagggtagttaggacttcccactgttgatagtacctggatgcttcatgttcttttgttcttttctgtttccttgacactgtccacacctctataaaatgaaccagtcgttaaactcttttaattgaaacactgccagggcaatgactactattacttgatagagattttggtttttactttttgtgaagtagggaactattctagggccttacatataacaggagaggaatataatgtgacttacatcctaaaaggattcttctttctgctcagttgagaatacactctagggaggtgaagataagaaccagtgagactggtaaacagaacgctgccctgatccaagtggaagacgatggtggctcaggtcagagatgtagcaagtggttagactctggttatatttttgaagacacagccaagaggattggattccctgatgagtctgaatgtagggtaggaaagaaagaagtcaaggatgataccatgaattttgacttgaccaactcggagcaatttgttgccactgactgagttagggaaggctataggtagagctagagcaaatttgatcagaaacggagagataaaaatttcaactgggaatgtttaaatttgaagtgtctgttagccatctgagtggaaatgacaaaggcagctagttatattttaaagttaagaagacagatttggactaaagatacagatatgaagatatctagaaccatgggactgggttaaatcactaagagagtgaatagaaatgaaaaataatagaggacagtgggctgagccctgaacacttcgacattaaaagttcaaggagagtagccagcagtggagaatgggatggagtaaccaccactgaggtaaaatgagtgcattgaagacaaagctgaaaaataatgatcaaacattgtaaatgctgccaagtaagaggatgttttatacatatatatatatatatatatatttcaaatttttctgagtactatgatatttcgacatcttaaaaaaaagtttatggcttgggagagatggccctccaggggctgccaatccttacagacagcaaaaacctcagcagggagaacacctttggtatgcaaattacccaatccagagccatacctcctttatctggctatataccccaggagacaatattcctctgccttaatttcccactgtcaggtatcaagcaactagggattaatcctataccttagagcctactgaaagtattcaaaccagccagttctaaactgtttaccctactctactctgccttgcctttaccctgaaactccagtaaaggctgtggcataagctctctcctctttcctgtcttctgccacatggagaaccaccccccaccccccgtgctgtggtctgtaatgtcaatgtccctccaaaattcacatgttaaaatatcaaccccagcgttttggtattaagaggccagacctttgggagatgatgaggtcatgagggtggagccctcaagaataaattggtacccttataaaagaggcttgggagagcctgcttcctccttacccctatcaccatgtgagggggacgtgcaacaaggcaccatctatgaagagtgggccctcagcagatgcccaatctgctggctccttgatcttggacttcccaacctccagaactatgaacaatgaattttctgttctttataaattatccagtctaagacactttgttatagcaggctgaacaaactaagacaccctgtgaccctgtgtggcatgcggtgacctcctgtctaagacctatgagtataataaactttgtttcattgtgcctctcctgtgtgtcctcttgcggtctcacctgtgaccatcacagaaaagctcacagaacagagaagttctaataactgttggctttagcaacatggaggtcactggtatcttggagctatttgttatttatatttaataaatatgtaattagctagcagatattacattaataaatggctatttagattaattttattccatctgtggggcctttggtcacaaaacctcaaatgagaaccacgaaagcatgaacatgactcacagggatggagttagaattctaacaggccctggagtgggaactaatgctttatcagtagctaacatgagacaatgctttaaatgagctctgttacaatgttgtaacgtatacactattttgcccagttcacagcctgactcagaaagcctgactcacagaattaaggtcatacagctcctgaggcccatcactaaattcaaatccagttctgatttggcagtttatgctgtttcaacctaccctgtactctccagtaataacataaaatagaatgattaaagaaggttaatctgaattatctgggaatcaaatctgggtccctgaactccctgaaaatattatttcctagtaacccatgccaaaaaaataagtcaataagacatattcctataatgcttgggaagaaatttctatttactagaaagaagtcctcagattaaaaaatatctgatagttacatatgatcttaatagtagttctgcaaacttgattaaatatttaagcttccaattgtagttggatcttatccctcttttctcattaggcagaaaatatttagaaaagctacattagtaaaaaccaggctaacttctttccacagctacctaatgacttcagtcagtattattgtttaaaattaataggccacatttaacaaaaactttatattattaaatttcttctcaaaacatgtttagcaagaatatctggctactcatctttttaaccttgacaactcatttccaatgcaaaagggtaaatcctactattaacagcattgtttttgtggaaacagtttaagacactagtcactagcatgattttctaaatatgcttagcaggtttatttggctacatatgaagtctcttttaaaacctgacatattatttccagtgacctgaataggatatttatctgagaaagcagaccagaataaagcctctatacagactttccagatagagaataaaaatagtatctaatatattttcgactttgaaattatctatttctgttatagtgtcctctggatcactgcccctgaaaaatagctgagctcctattttagcaatatatactctcttgaggtggtttcagaagattaggacacagagttcaatacaagctatgagaattccactgcagctggcaaacactgaggcctgtcatagacttttcttgtttttccacatgagaagcaccttctccactcctctcttccatccacagggaatccaattctgacttgacctttgagatacccatgagaatgtccattcttctacccctctgccataatacaacctactactgtctttcattcaattgaaggtgcaagtaactgatacacacacacacacacacacacacacacaaaggtattgctctcaaggacatttacttaatttttaaaaaaggaatcaaagcttgaaataaaataattaaattctactttgaaaacaagttaacctggtttttgctagtacagcttttctaaatattttcatcctaatgggaaaacatcagcatatgtgacaattacccttattcaagtcacattaagaataattcaaaacattaaagaaaatactacagttgcaggggaaacaatttaaataatataaactggccaaaccctagtgaatcagatgatgatctatggaaactgaccaacggaaaatatctaaagttcaaatgcccttataatagctgttttctgccatcttttaaatgtctttccatgtcaaatccctcttaagtttgatacacagtctacttaccaaaaaaaattgtttaacacatatatgattatgaatttgaataataaagcaatattgtaaaatatcaagagtagtaaggaaataacagaggactgtatccaaggtttccattaacatcataaatgcactaaatgcatttttgtgagcttatgttttccatttttgtatttctttctctgtgagtaacgtgtaagacacttaagagaggcacaggtagacacactgcagcaacaagaaaagtctaaggttcttgttatctggtaccagtgctgtggacacgccacttggaaggaggaaccactgtttttcctctgtgaggacaacacactgcatctgtaccaggtgttttatgggaagagtgaataaattttaatcattcatcgccctcttatgcttagatgtttgtcatgatcacacagtgtgggatctacaaatcaacacaggaaagttggaattatggtattctgttatcagaggagcctgtgatctgaaaatagctgatcccccaattttcatatgacacttgtgtgaagaaaaagaacagaaatctccatcagtaccaactgttctcagaaaaggcacagcctaacagaaagaaaagaatgagcacgttggctgcagaaagccctattacggtttacacattaagaaacggagaggaaacgatccaaaagaaggcaaaatttgaatatttcctgtttccaatgtcacaaaaattacagagtaaaagtgaaatcaacaccaatatgttaaagaaaatattttaatgttatatttacttaatttgacattatttaattggtcttacactgaaatcgacactactcaaatactttttcaagaggagtggccttcaagtttttcctttctctgttatgcgatttgacacaatgaaattagcaagtttaagttctcatgttttataaggttttcatgtaagtgctacctctccaaactggaattttaatcttttggacagtcaaaaggtcttacatggtagcattcatctttctttcttaaacacaatacttcagtaacattaatctttcaggtgggtatacaaagagtacatcaacgttgcaaacaacctggagaaaacaaatctagaaagtacaatgacgcaatgtcacaaatgtggttgcctcctgctacagcgtgaatgtgttccccaaacttcatgtgttggaaatttaatccccaatgcaaaagcattgaaaggtgggaccttcagaaggtgattaggtcatgaggctctgcccacctgaatggattaatggtattatcttgggagtgggctccttatcacaggaatgagtttgttatataaagttccacctgttcttgcactctggagaaatctctcctgatgtgatgccttccaccatgagaagacacagtaagaaggccctcaccagacacagccctgcaaccctggactttccagtcttcagaattgtgaggaaaactaatttctttttattataaatcatccagtttgtgatttacagcaacataaaacagaccacgatacctacccaaagtacattcattctcctttccttctttgtgaaaagaatttcaatattgttagaaagtgcatgtattttctttatcggcttctcttacagccaggaatggcaaaaatgcacttctacctgagaagatgtaagggcaaatctactggggatttcagagaaaacttttgctttggtttgaatgtgttaaggcaacaacctcctctctcactattctttcttccttgaaatcagacataaagctgcacaacaatcagccatgttgtgaccacgaggaatgaagcacagaaggccaaactctaaaaatgatcaagtgaaaaaagcacaggagtctggacattgatgatatgatgttgctccatgtggtaccagcccttaaacgcccactggggccttttagttactagagaaaaataaactccaatttgctttagccactacagttagattttgttacacacaaacaaatcccattttaactgatactctcaaaatagttagtgaaatcaccagagaatgaaataaacttattttacaatttgatcatacctataaaaataataaatgtcttcctagtatacaaaaaaacagaagcaggggaaaaattttagagaaggagaccaaagaaagaagaataaaagcaaaattttaaaaagtgaaggcaaatagtagagaggttaaataaagatagcactgaaaattgatgggaagcagcaataattttcatgtgtaggtttgttgttgttttttaagagacagggtcttgctctgtttcccaggctggagtacagtggcactatcacaggtcactacagccttggactcctaggtttgagcgatcctccaccctcggccttcggagtacttgggtatatgccaccatgcctggctaattttttttaattttcatttttattttttatttttgtagagatggggtctcaccgtgttacccaggctggtcgtgaactcttttttaattacagctgagtcattagggtgaggttatatttaatatactttacttaacacaataaaaatttgagttattaaactcaacaatgctcatctttagaagtccagaaaattcacttatagaggcggcttcatttgtttagaatattaaataaatgacaagttagtattctctgcttgtgaaatttactggttccctgtgcattgctaggaaaaataacagaatcaataatacatattatacagtttatttatgatatgtcactacttgcaattattaaataatatatgctataggactacttaatattaatttagcagataattttaatagaatgaaactgcataataaataaaaattttgattcatattttgaattattaaacccagcaaaaattatgagaattaactttatgagtgttagtttttaaataaaatagagaagaatatgtaacatcattaataactttgaaagccacagagccaaatgagtgaatcacttctgctcgtcactcagccactattatttcgttatgctaattacacagtctatgtgtttggagtctgttaaatgtttatttttgtggcaaacaactatctttgcatatgtaaaatggggacaacatgtgaaagaggagaatatgaaaccaaaaatttaagtatcaaagaatcaagaaatggaaaaatataaccaatcctataaaatgatcctcccatatacactcaataagtaaaaatacacttcatggtccagactgtcttgaagatatattacacattagaacatatgcttgttagtgggtgcagcgcaccagcatggcacttgtatacatatgtaactaacctgcacattgtgcacatgtaccctaaaacttaaagtataataataaaaaaaaaaagaatgcaaaaaaaaaaaaagaacttatgctttactgttgctttctgcacttgaaacatcttgatttgtatcctctagattgtcaggtaagaatatcgttagagatcaattggtccagcctcagactagggcaagcttcagcccgattgatcagatgtgaacacctcatatggtcaaagtgccttgagcagaggaaatacactgtgcagataatactgactcacaggtattataacaatctaccagatgggaaataacgtggcagaagtgacttttagatatttaccctggagtggaggatgataaatccactgctccaagtagaagcaagtaacctgcagacagagggcttgtcaagtataaaacctttaatcatttcagatatactacggattggcctatgggctccagctctagaattttacaactgagaaaaaaaaagtaatgaaagagaaatatgttgtgttcataaataaactattagaataaataatttaaacaagattatatttcttatttatcatttgatgttgattttttaacccaaaaccttaacttgaaactcttaatcagtataaaagagcttgagtatatttaaaattgtgttggacagcctgtttcttaggataactctatatgtcagccaatcacattttttgaatcacctctaaacattccattgacttttgtaattgcagttaaaacagttcatgtgacatatgcaagcagttgttgacagatgagaagataagcttataggccatgtattgtatttccagctgttttaaatttaaattaacattctttcgtaatttctaattttgatgattatgatgacaaattcaggcttgcaaaagcctagactcaaactagatttttgaatagttcaagtgtttaattacttattaatctgaatgaagtacgtaatatattttcttgtttgcatttgtttttactatcagttctgagacttctcatccaagtttgtcctctctcagttctttctagttaccatttcccaaacaatcagagatggtcaagggtcattcccacgctattaacacttttaaaagctagaagaaacaaaggtataggcttaccaaaaaaaaaagaacctttatttatttgaaatgtggcaattgaataaagcttcttaaagtatgtacaaaatataaacacataacattttaaaggaatctatcagccaagcaaagaatgttaggttataaacacacaaattatcttaaccctaagggtcaataaattaagatcatgatagtacaactttggaaagttactccataatcgaggcaacatattaattattaaaatcttgctttacataagtctgaaagtgttattttgagaaacaaaggtaaagttttaaaattataaaacattttctgatttccatggaaggaaataagggaacaagaagaaaagcagtgccttagcaaaaaaaagcaaaagttttcccataaatccctgctagattttctcttatgagcaagaactattcgagggcaacattagctgcaaaggacgctgggaagtgagttgaatttttttcttcgttttttaaactgggtacatgtgacctcaaacacaatttggtcaaaactacatttaaaacctccaattaacactttgaattacactaaaataaaaaggagccaatgaagagaggcacaatacaaaacatatgatcaagttcacaatgagtagaagcagcacaactgtgccctatatttcacaggtgtggccaaggccacctacagaagagtcgtacaagagaaccaaagccaaagagagagaagaatatgggtcagaaaagaatcatcacatcctgatactgacacacagtggaccaagccctagcttaacaactgtcctttattcaataaaatatggtgcaacggccaaagatttatggcaaaaatagaaaattgttaacattcataaagttttaggtgtgttttattttgcttggctttggttttttgtatctatcaaaatgaacaacttagacatgctaaaagttttatcatagtatcaatatttatagttattccattatttatctttaatattttaaattataaatagcacagtaagtgttgtattgttctaatatctcctgctttaatatttattacacagcataactggacgggagatgttttaacttcactgaacattaaaaactactggccgggtgcggtagctcacgcctgtaatcccagcactttgggaggccgaggtgggtggatcacaaggtcaggagatccagaccatcctggctaacatggtgaaaccccatctctactaaaaaaaaatacaaaaaattagccgggcgtggtggcgggcgcctgtagtcccagctactcaggaggctgaggcaggacaatggcttgaacccaggaggcggagcttgcagtgagccgagatcgcaccactgcactccagcctggccgagacagcgagactccgtctcaaacaaacaaacaaaaaactactgcatgggctttgaaatagctatgtaactaattgttattttttgcttcagtctaagttcttgtctatattcatataccataacaaatgagtcactattgtctatataaaacttttaaatacctaaaacactttacatcttggaatcttatagaattggaattttactgaatcttatagaactgttttcctcagattttatataatacctaaatactggcttataggcaataactagctaaataataaacaaatattatgaagtgacatatagacatataaaagcaattcttgttatatataggccaggctccgtggctcacacctgtaatcccagcactttgggaggccgaggcaggcggatcacaaggtcaggagatcgagaccatcctggttaacattgaaaccctgtctctattaaaaatacaaaaacttagctgggcatggtggtgggcacccgtagtccctgctactcgggaggctggggcaggagaatggcatgaacccaggaggtggagcttgcagtgagccaagattgtgccactgcactccagcctgggcgacagagcaagactttgtctcaaaaaaaaaaaaaaaaaaaaaaaaaaaaaaagctattcttgttatatgtagaggatctattttatagtcaaaatgtgcctaaatatatggttcttcagcttattttacagcttattttacttgaaggtataaccacattctaaaataatctttcaaatacaacaacttggtatcttttctgtttatagttcaaaatgaatttttttccccacaattatgatcactgagatgctgaacttgaatcagagtaaagcataaataggaaaaaacaactacaaaacagaggacaatacgacttcacttgctgatggtctagctgtggcaaatgcagtttcctcacaatagacatacttgctggcaagctctgatgactaaactgtgctggaagttacacagaatttcgattgctatttgctcacaattataattgggagcaagaaagacaatgccaaaaggaaataaaacacatatttaggaaaaaaaaaacaagtaaataggagctttttctagtaaagaatgctagtagagggcaagttgttccttaggatgccccccgccaccaacaaaaagtcttcaacagccagccagaggccagaaatcccaaattatttaacgctactacatatattataatcaaatgttggatcaagtaggaataacccaattaaataattttagctaaatcatctaactctgatggcaagttattttgttgaacaactaaagatttataagggctattgtaaataatatttacctctcaattaccacattcccagaatagaagtcatgctttgatgactaaacatggcccggcgtcaacccctgctgcaagacatttgctctgatctaaacaccccctagtttgcatgtacagggacaaaaccttctcaattttctaagaatatttctttctgtcctcataaactcgagatattccccctaaaaaaatgctgatttcaaaatttagcaatggaataaatcagtttgacaaaattttaacaaaattttacatgttgccaaagactggccaccttctgcccccaccaccaatcaatcaatcatcacagaacaggaaaaaatgtctaattcttcagattaagtgcacacgccatatgctagaatgtatagtgctgtatttatgaatatagtctatgtactaagtttttcaagccataaaactagctaatattacattaaaatcaaagctatcctaatataataacatcatgtataaatcaaaatagtgggaagatgtacaattagagatgaaaagacaacagagctgatagaacctgattttccaaaagaatttaaatttaaatttaagaaaatctagtcccaatatatagtattttttataggatgatatttatataagtaatacaaggtggtataaacaatgaataattcctcactgtgatggacatagttattttgtcattagtaaaagtagtttgaagtaagaagttattggaagaagtttttttctggaagaagtttaaaatgttttaattgcaaaatagtatactggagtaaaagaataaaaggaaagaaaagaatgtgtaatttataaagaagatttgcataacacgtgtctaaaattttggtttaaaaaagagtactactctttctgtgagcacccaggggcacatcatcaagtggggtgaaacactttcctctggagtgaaacattaacctctaagttacaatcacttttaacctcctgaggagaccatgctcctggaatgactgcacattttcctattgcacataggaagggaactgctaatgtcagtgcgaaagcaaagcccccagataggaaaaaaaaaaagataaaaggctccctatcgatttaattaactcaaatgttaatacgttaggcttagaaaaccagaaactgttctggacaagaatgaacttaaacatggacagaaaacaatgtgcgaatgtaccaccagtgaaatcatgtgtcttcagaactttgtgtgctattaagttggagtgaaacccacagtaacatgtattaaagcccatgtttaagacatcttggtcatattttattaaagaacgacagctcttaaacatgtacatctttaactggaacttgttgcagttcttagtaatggcaactgattgcttggcattttacaggggtatctattaaaactcttttctaggccaggtgtggtggctcacgcctgtaatcccaacactttgggaggcagaggcgggcaggtcacctgaggtcaggtgttcaagaccagcctggccaacagggtgaaacccagtctctactaaataatacaaaaattagcctggcatggtggtgcgtgcctgtaatcccagctactcagaaggctgaagcagggagaattgcttgaacccgggaggcggaggttgcagtgagccgagattaccccactgcactccagcctgggcgacagagcgagactccatctcaaaaaaaaaaaaaaaaaactccttctaacccattcactaagcactaagcacgcatttaatacccatgtgtaatacacagtgcaccaaggacagcatggagttcatctcgacatcacagatttaattttagctgtacatatattaatttatatcatttcaatgattgaatggaaaatgaaattatatctatacagttatattaaatttaaatcaggcatatgtgtcctcctccttcccaacacattgcagatatttaacaggggtgtaataaagttaaactcaacatcaaggatacatttaattaggaaaatagcacagaaaagcaaaatttgaatttcaggtgttttgcactagaggaagcccgagcgtcagtcttctacgtgtgtcgtgttaacatgacttgaggctgtcacactagcactgctcctagttttagacagatagaagaataaatgtcaaatcaacatggcacaaaaaatcaccaattttaaatattttcaatctttaatttactaagttatgtgtcactgtgtgctatattatagtaataaaataactacactgtgctctcatggacatgagcacaaaggtacatttttctaaagtaaaacagaattggtctctaacagagcaggcttcactgctaccaatattaaaggaaaaaaaatattgcattaaaatttatgacatcattatttgctttaatgtgtatctgaagcagcttcaaattacccaattgttaagtgtgatggtcatgactcatgaataattttggccttaataaaattctaatttggcatggacagacaccaaaattaaaagagagatctaggactcagagagaacaaacaatgaatcactattatgttaaaactaaaatttggctctgagacaaagggatcagtttgttttttagggaagtcataaatgtcatgacctgtaagcaaacatgaatctcagtaagtgttctcttttttcaaaacataaacttggaagaggacttttaaaaggataaagtaactaaatacacaaaacagacacaaacaaaaagaaagaattaaaaatattccatgtaggcaatgatattatagtaaattaaatcacagtgatttaaaatagcctcgcatctggtatctgatatcaactagctacttccaagaaatttggagtgagtggaaataacaatcccttttacaggttataggaattcaatcacaggattcatggcagctgtgtggtcacttcagttaaaacagagtagtcaagaccattttctttaacatttcagtctgatttgccaaattcatccactcttggggcagggagggacctggaggggctcatttaattgtaaacaaagacaagggaaggtgaactgttttcactattgttcaccaagtgaactatttggtaaaatcattacccacacatccttttaggtaaggtgattatgtttgtcatttcagtaaaagggcgttaaactttgaacactgcttgcctgaagcagattaagtagtcggcttcccataccctattcaattaccacaagggagaaagtgctgcctgtctcagagtggcactcactcacacgcatgactcttcctcaactaccgcagtgccaaggtctgattattttcacaaatgtttcatccttttccaatattttaacaagttggaaccaaaagtattatcaagttcaagactgtttcttctacataaaaagaatattaaataagcagttatttgaatcctgtttctaacaataaaaatgtaagcaaagcacttgtaagagaaaaagaaattaggctggaacagcggctcatgcctgtaatcccagcactttgggaggccaaggcagatcacttgagcccaggagtttgagagcagcctgggcaacttagtgagacctcatttctacaaaaaattttaaaaaatagctgggtggggtggcacgtgcctgtgatcccagctacttgggaagctgaggtaggtggatcacttgagtacaggaggcggaggctgcaacgagccacgttcatgccactgcactgcagcctgggaaatagagtgaggcctgtctcaaattaaaaaaaaaaaaaatttttaaataaaaaaaagttgagagaaaaataaattagtgtgacaatgaaaaattactatgaagaaaatcacattaaaatgttaatttgaattctataattgggaaaacataatagcactgaactataaagcttcattttattatatgcttacatacaattctaattctgaaatacaaatattaatacgaaaattgcttttaaaaagatgatacagtatctccatagagatgtgaatgaataatatagtattatctaatttttaatgtacttacatactacctgagggtctatttagtgtttagtgctttgttccagttccagtcagaaaaaaaattctgtttaaaaatgtggtatctggtcaaaagttctaaaatactccaactaacatctgcactggaatcctagggaagtgaatactttctggatgttactgaatcaaaaaaatatgctgtcagctgttcaagagctgggaagtgtgtccaccactgatttttcctccctttttcctgtctgctcacgggcctccaatgcccccagcactgtagtcttcagcacagggtaaccacgcaagtcacagcactgactggcaaattgacaaagagaaccaccaaacaaaatcaactatttggaataaactagagtactcaagcaaatcagcttactctcagagaaggaaagtatctactccataattcatcccagtgtcccagtgtccgcacatctcagacagcacacgctgtactagttaccattctggaagagggtcccttaggaacagtgcaatcacattttcctaaacaaattcacacaagtttaactctggcatatagcattctccccttaagttttctttatattttcctcagtgaaattgttgatattttaggtattctgtgatgatttcattgtaaatttagaatgcatatttattttttgtggcaataatatagatgagatatttacacatcaaagtagcaacattagcatgtttcattaataaacatttaaacttgaaaatgtatatgctctgaatatattcaagatgagttcatattaaattatatggcattataaaaagcttatgtgtaccaaaatcctttacagccaaatgacctaagtatgaatgaagcacataaggagacagcatcatcccagattctttggtttggtgtggtctatggacacctgtgctgccctccaggagaggaacaaaccccggcacccaggggaagtgggaacatattataggcagaactacagtatgtagcctccagacactgaatgattaaacaccctgcatttccttcacctgtttcaaaatcaaacatcagtattatatcctcttgctatattttagaaattgggaaaattgtcagtaatttataattttaaaaatttaataaattagttgcaaggtgctgaagaatcacagttatgtcatatgtctaggacatagtacttacatgctatattctttgtttgttttctgatcatgaagactatctatttaacacaaatttacagaaagcttactatatgccaatcatggttccaagggctttatatgtatgcacatgctgtttttttttttttttttttgaaacagagtctcactctgttgcccaggctggagtgcagtggggtgatctcagctcactcactgcaacctccgcctcctgggctcaagccatcttctcacctcagcctccagagtagctgtgaatacaggcacgtgtcaccatgcccagttaatttttctattttttgtagagatagggttttccccatgttgctcaggctggtctcaaactcctgggttcaagtgatctacctgactcagactcccaaagtgctgggattacagacgtgagccaccacacctggcctatatacacattcttatcctcaaaacaacctgattaagcaggcattaattatattctacattttggaagaggacttttaaaaggataaagtaactaggctgggcgtggtggttcacacctgtaatcccagcactttgggaggccgaggcgggcagatcacgaggtcaggagattgagaccattctggctaacatggtcaaaccccgtctctactaaaaaaatataaaaaaaaaattagctgggtgtggtggtgggcacctgtagttccagctactcaggaggctgaggcaggagaatggcgtgaacctgggaggcggagcttgcagtgagctgagatagcaccactgcattccatccagcctgggctacagagccagagtctgtctcaaaaaaaaaaaaaaaaaaaaaaagataaagtaactaaatacacaaaacagacacaaagaaaaagaaaaaattaaaaattaaaaattagcatctactcattgtgctacaaagaagcagagagaaactaagtaacttgtccaaggtcacacaggtactaagaggcatcctcaggacatgaatacagaaaggcatgtccataccctgtgctcttatccactgcactgcatctctaaacaagttacgtcactgacacaagcaacagttatgtgactgaaacaagcagaaatattggcagtgagttcttccaggcgctatcacaggcagtgtaaacagagtgcataggttctgcagttagcaaaatagctagctttgatcccagcctttatcacttatgactgcatactttactattgcataaaagtaagagaaaatggtaatttagggatgaagttttaggtaaattaaattacaaaataaatgtctaaatagaaacctttcaactatagaagtcaaaccacatctttctggtctaccccaaaatatacatctttccacctgtccaaatgaggacaggttgaagccaaacttctttagaagtgagtcttttaaacttgtaagtattaccttttacacaaagttgtgcatttgaatatttcctctttcagtatgtcctttctctagtaggtggcatctcttgagtttgagtaaattattccaccatatttaaaaaaaccttttataagaacagccaaagtatttatattgtttatttggtagtttacccacctcctcacatccccactcccacctttctggtctcatttttagcagattttaaaaagcaggaatttccaggacactttagggttctctccttctcttttttttcaattgcccactgacctacaaataaatgtgtgtgcaaatatagagattctaatcttgtacacttctgattgtctaaatattctatttcaatgaactgtctacaaattcttaaccatgcaagaaagaacacgtaagtcacacttggcagtctgaagaactattaagcggtgtatgcatgaatatgtgtgtggggggttctgtgtatgtgtatctaagcatgaccactgtttacactgcttgcttcgtttggaatgcaaaccataatggcagagatgtctatttctatacttttgtaaatgtatccagatagcacaatgatgggtgcctacagtaagtcaaaagtaatcaccactatcatcgccagcaatcaggagcatatagaggagttcgaataccatatatgggtggccactgtaatgagaaaggcagagtcactgccagacactttaagaaaccctgcagttgaaaatggcttctgagaagcttctgagaagcttctggtcagctttcttagacacttctgtgcaacaatgccaggttaagctccttaaaaacctcactttcagcataccactaaagaatcttcattggctcctgctgctttcaactcaaactcagactttctctttggttttcacacttcccaccatgctcccttcagtttcccttaaagctcttgacttttgcaccaaagggtttgcttctagttccccaaatatccctgacctttacttcctctgtactttgctgtcattcttcaatattcaaaacatccctctctcccccatttctgtaattagcatctactcatttttaacattgggtctcatatcattccacctttcccaggcctgcccatgcaactcccagaaggctagccaacaactggtggtaactcacaagactctcttacaaaaccacttacatggtctggatttatagtttaattcacttgtagtatttttaatgagtaaatttattttctccaaaatgattataagcttgttatagacaagatcactcactctacattttttgcatcacacactgaactgtaatttcctgcttagaactgaagctgccactagtaagaactgattaacatgagttgaagtagattaaagagcaaataaacctggtactaatgggtaaaaaggaattaggagcatccacatggcttctttcttgaattcctggattacctttccctgcctcttccaggcagccccaaggcaataaagcaatggaggaaggcctgtggaacagggctacaatccatctgcttatccaaaatgcctggagactgcaagagtctctgaacctggaatttttctggaaaccaagtgcatagacatattaatactcacaccccaaaaacaagcaggactgatggcagcatcatgtaaataaatacattactattttcccagtgaagattagaaatatttaaattagataataatgactataaatagccttatgtcagttcagatcaggattatagcaccaaataatttaagaaaattagcttttggggccgggcgcagtggctcatgcctgtaatcccagcactttaggagatcaagtggatcacctgaagtcaggagtttgaaaccagcttcgcctacaagacaaaaccctctctctatgaaaaatacaaaaattagcctgctctagtggcacatgcctgtaattccagctacttgggaggctgaggcacgagaatcgcttgaacccacgaggcagaggttgcagtgagccaacatcatgccactgcactccagcctgggcaatagagcatgaccctgtctcaaaaaaaaaaaaaaaaaggaaagaaagaaaaagaaaatgagtttttggatttcaaaattggaaaaaaaactatcgtggataactcctaacacctgaaagccactagggcgcgagcagtataaggaaacagtactaatccactgacaaagcatttaatgtacaatttgattaattccatgatggatgcccaataaagcaaattaaataaaaacagtctctgctttctcatggttaaacataaactctgaaaaaaaaaattaatcaaccgaggaaagaagccaccccaaaaatttacactagtaagtttcagaaaaacaattacacaaacctaaaatatttatagtaaattttataattacactataactcaaactcatcagcatctctccttgtttaaagttctctgctatatctgttttttctaatgagaaaaatcaatgataacttaatccacaatttatacaaatctgtacatacaaatatgtgtttgtaacaaaaggtagacccatatagtatttataaaatgcacatctacaaggaataatgtaactggtgaaaggtgaaacaatatatgctcagaagtcagaggaagtataacgcttctgccaacttaaatttgttctttccaaatccacttatttgtgaaaggtcatttggcagaggtaaaatcacaatctttcactgaagttacttgagcacaactttgaaaaaccgtttgtcagaaaatcttgttaagcctccagttaagcagtcgttcttataatattaccatggattaggtcatttataatttatctttagtcaaacgaacaccatgtggtaaagcctggaagaaagtctgggtttatttccgtttgtcccgttgtggggaattaggacctaaataaatgcaacaaggtgcccctaactgcaaagtcacacgcagtgcttttctctgccttcctgcacgctgctatagtgtgccaaaggagaccagcagaggggctgaaaggagtctgaatcacaggcccaaaggcccaaacccattaccacatttctctaaaacatacatgcttctcgatttacgatggggctacatcctgacaaattcctcctgagttgaaaatatatttaatatacagtagagtacctgttgtttactctcacgatcacatggctgactggtcacagctcacttccattgtccagcatccagagaaagtattttactgcatattattagcccaggaaaagatcaaaattcaaaccttgaagtatggtttctactgaatgtctatcgactttgcaccattgtaaagtccaaaagtcctaaatagaaccattctaagtcggggactgttggtatatgccataaaactttttttaaaagaaaaaaaggaaaaaaacatctattctttttcctggttaagtcattcagatcttgggttcatcatccttaatgaaataaaataatgtccatattatggaggtgtagtgaaaaacaaaactaacttgcaaagctctttgcgaagtgcttaacacacgttatgaacatcacagataatgattataaactcctactctcaataacaaccccaggactgccaaaggcaagcaggcaagcacagtcccagggattcgggaaaccttcattagtctcacgccagttcctctgttggtgaaaaccccagcaagagctgagaaacagcattctgggttggacacatggagataactaggaggccaggaccttcctctcaagaggaaccggaaccagaactggaagtccaaaatgaaatctaaatccactaccctccgtctttctcaactcaactgaaaaggacaggattagagatctacgggtcttagacatatgccactaagatcagtaattaactgctttctatgaagcaattttgataactgtcttgtgaataaatagctatcaatcagatattcatagttcagaagactataatggagtggaaatcaaaatgaaagatgaattgaactttctatatctaaaacctcatataagtagcatcactcagaggaatgtcagaaatctcttataagagtagatgttgacaaacataatcatatactataagaaaaattgtaaatagaacagcttcagacttgctattctcttttgttcccatcatgtccagttaattttacttttgcctgccttacttttttgacactgtcttgtttgtgttaacatccttcagagaaacattttaagacttttcagtaagtcatgcaaccacaaataactagaaataggaatccagtaaatgcaaatataagtcgaggaataaggagatcttcattctatttgtgatttttacctacaatcttttgcatggctttacgggtgggctgaagggctggatggctaaccttggttcatagtttgtgtgctatttttgattttttaaatattaaaaaagttcctaggtgaaagttatgaaaacattgcatctattgggattatagatatttagcatcttctgtttaccttctgaaatattttcttggggttcatgtagttatagaaaattaacaattgatttctccccagttcttctctagtgcttaaatctaaatgtggtgcttgtacaggccactagggagagacatagagtcttcatatcagtttcttggcagttgtgtgacatgtttcatagcaaggacacagcagtttcactgaatgcattaatgacacatgccctgtcaaggctctattcacccactggggaacgacactttaatggagcaatgaaatactgctttgtggtctatggaactcagagatgatgtttcatatgggaaatgatgtttcatcacataggaaaggaacccacatcacatgcagaatactaacccatattcaccatacagaatataaaaatggttaaatatgaaaagcgacatttgcaaacaaaaatgcatagtgattttcacagcaatggtaaaatttgccatatcaccaatggcaaattttacatcaccaacgaagacacttttgaaagttaaaaataagttaacttttttaatcctccaatcccatacctatacataacacacgtaaacacacacacacacacactcaaggtacattaattctagactcacccagcagtgagtgactctcatacaggctattggcttatcagggaatgtttctcattttactctctactgcacattttcttactgtaaaccaaagtaagtgaccgtaaccaatacagagatgttgccttactaaatcatacttttactagttttgactttgcagaaatagcaaataggtactgcaaaatcaaggactcaaattatcagaagcgttattgagccgattattacatttctgcggtatttaagaacagaaagatattttcatcactatagttacggcaatgtaagtataggcactgaaaattatttttgtgattcacagaatgcagtctgttctatttcatgtatattgtttttactcaagaggcattcctttaacccctatattaaattattacacattccaacattttaatgttttcccaaaatttaaatgcaaaggtagtttgatttccaaaaattagtcttctcaatctttaagtgtatttcaaaatataaatataaataaaatatttcaaaatataaggctattttctacacattgtgtatgtgttaatcaacagtcaaattaaagttgactgtaacacaccacaggtacctctccacttgccaccagttgaaataaactaccgcagtatagttccagcaaggggtactgcaagtgtttgaactgaaatgtcgaatataacttctttaggaactctcttaagcatactctatatggttatggcaggtatgaactttttagataaagatatactcttttggaagagccagtaagaagtaggaacacacacaaatcctttttcaaaatcaggatgcctcaaaagtattttggcaacattttcaggcaaaggattaaacacctcttatttaaaagaaaacaaaacaaacaaaaaacccaaacaagaaaaaaaaaaacttagtttgcagtatctcatgaccagattttaggaatgaagagcttataaagttgaaacaagccttgcattgcttgattgtgatctaactgactctaatctcccgttacatctcaagtctgaccaacttcaagtgaactctgaaagctctggagcctggttactaaagtccctgacactttttttctaaagtcgctcacagcgcctggtgctctgcagactatgaacactccaggaaagtaaggctgggttgactgatcaccagtgtcccagaatctgtttggagtcccatgaatcagctggggaaagaaacgagcatttcccgaccaaaatgaactcatactctccagagccccgctgactgggcagggttcaagaccccttggttgccccagaggaaaccagtctgaaatagatttcgggatctctcactgggcacctctccgggcccttcactcgtgtaacttgcttgcctctctagtaacaactttctatttaaaaagaagaagatttttctccaaagcagcgtgcactgagctcagtaactttggatcccacgtacacaagcttaaagcacacacactttcccccgcgcaggttctcgggtccgccgcagaccctaacgcaaactctcgggttctccgcaaaccctaacgcagacctaccgtggcctcgcccgcgtcgggctccgcgtccgagaggtcgagtccggactcgaaggcggcggcggcggcgggcgcctcgcgaggacccgggagcagcgcagcggcgagcagagaacacgccacagagaagaagcccagcaagtgcatggtggaaggaccgggggtgggggaccggtccgctggcgggggcaggggtgggggcgcgggcgcccctgcgaggccgcgggcccctcctggtccctctcccccgggctcctcccggcgaccccccctgggcgagccggaggcggcgggagcgggtccggggctccgcgttcccaactttgcagggcgccctcccagccagtgccggggaaaggcggcgggtgtcaggtaaaagcctcacaggaaaccggacatccgagctccccgcattcggagcccgcgaggtgaagcgagggcgagggaggacgccgccgcggtccgcgtcggtgtagctttttggagaggcggggcgggggacaccagaacaccccgcgatgttcagcccctccaaacccgccagagccctcgtccccctcctccctccccttccccgaagtgagaggagccgggccgcgggcgctgcggcgggggcgctggcggcggtgccgggggcgggaggagggcggcggggcggctggcggcggcggggcccgggagcgccgcggcgcaggatcctccagagcgcgccgggctgagcggcggcggcggcggcggcgggcgcaggggcagggcatgactgacgcgccctctgcctgcgcttatgtgagagaaagcggccgagggagggagcgtgccgagcccgggctgccctcccctctcactctccctcggaagccgtctccctggagctccccgtttccctcgcctcctccccggcggccccacctcccccggcccccctctggatctctccctccccgcccctgtcccctgcggggagcgggcggccggaggggcaagttcagtcccggggctggcggttggcgggaccggctttagaggtgatgcgaccaccctggaccacgtgcagcggggagaaactgggcaccgtggggtggagggagcccccgctttatcctcggccactcccgagttcttgtcctccctcccgcacgcctggcccccagagccctgctcaaagtttggaaatgtcctgggggttgtaaaagttccaagaaaaggtcatcactatgtcagagaaccctatgggacctcggaggggtcccctctctcccttggtctgtgtagttgaaagttgcctgatgatccaagaaccgcagttctcaggatgcagtgcaggctgttgggatggatgctaatgatccctttggaatcctaaacttctgacaggtgaagagaagggccagaatcttcgtggagagtaaagagacacattgtcagcttctgcaagaagttggtttacttgaaaaagggggtgataaagagagatgtgtgtgagacatattccagaaaggatgtgtagcatccaaagaaaagtgactgcatttccccattggaaaagcactggggtttccgttgggctggtggcattggctagctgcctccttggggcagggtgagcaggttacagaggaccacgctaaggggtttcaacagtgtacagaacatcaaaagtctgcctttcactcccaatctacttttaagtacacagatgttataggtccataatatcttaccggaagaagagactttcttatctggttcaactctagatttgaaactcctcacccataatttacttgaaggcttaaatatctcaaaggacagggaaccttccattctgtgtggctgttcactccctttattgatgagcaacactgctgaaaagcatttccttctatctctctattgcttttgactcctggagttttacacaataaatctaatctcacttccacaactgagtccttcaaatattttgaaaatatttatcatggtctccctaagctaactttactcctggctaaatatcccttttattccccaagatgacagttccagtttccccccttaaccatactgttagctttccatgttcatgaagtatgcggttgagaacatggctcggtacttagtgctgtaatgagcatgcagaatggacagtatgcctttgttgatacagccttggattgagtttattttctggcagccaaatcacagtgttgactcacactacccttaaagtcaacaaaattcctcaataatttttcatatgtactgctacttagtcacgtctaaattcccctgtatttgtggagttaagtttactgtatccaagatgcttttttatgtatctttatgaaattccatcccatcagactcggtccatgatctagcctgttgagatgttttgtgatttggaacatggtcagtgtatcactctcttgctgtcttcctgctctatgcatatttgatcagcctgccatagttatcttcagacattgatagatctgtgaaaagggaacagctaagggcagactggggtaggatttgaatagaaggtggagtttccattcaaccatttgctattacaatgattctaaactttgattgcacttggcatcacaaaaggagattttgaaaaaacagatgcttgagtacaccttctgcctttctggcttaactggtctaactggagtaaggcttggacatcaggattctaataggcaaacaaaattgagaaccacaggcatttccaacacccacaggcctagcagcgggtgaagactggaaaatcaacaaactcaaaatatatccaaaatatattaatatcatattaactactgtttcatttaaatacagcagtaagctgtattcaaacttttttctcacaaaagtgttatcttcctgctgctatactttgagtcagaaaatgctggcaaaaagtttatttgaataaaaaaaaggtctccaaaaacaatcatgcagtagttgtttgtcttaaggttggtcgggcacggtggctcacgcctgtaatcccagcactttgggaggccgaggcgggtggatcatgaggtcaggagatcgagaccatcctagctaacaccgtccatcttagggagaccatgataaatattttcaaacgttggtgaaaccccgtctctacttaaaacacacacacacacacacacacacacacacacacacacacacacacacacacacacacacagaatgtcttaaggtaaaaacgaatagttgctcaggactttttggttttttttcttccttaccccctggaaacactttttgccactagcagattttaaaggttgagaaagtccttttcactggtttgtgagttcatcactagcttcatgcaagacctattttacaacaggtcttctaaatctggttattcaaaaagcattgctcagtcagtggagaaagagaggtagcagggccccagccagaataacacctcttttacatattgagtttttgttttctttgatgataggttttgttctttgtgttttgtgtctgtgtgtgtgtgtgtgtgtgtgtgtgtgtgtgtgtttgtttgtttgagatggagtctcgctctgtctcccatgctggagtgcagttagagtacagtggcaccatgtcagctcactgcaacccctgggttcaagctattctcctgcctcagcctcccaagtagatatgggagatgatagttttggatggcaaaataatgatgataatatatccattgtacattctctaatatccattctgaccatctactttatttctcatttgttattccctaccttcttgctttgttagttttactttgttgcttcatttcaagcttttttagctgaatgcttagttcatttttcttctttttagtttaaaaatacaagtttcgggccatgtgtggtggctcacatctgtaatcccagcatttggggaggctgaggaaggaggatcacttgaagttactttgagaccagcctgggcaacacagcaagaccccatctctgcaatcaatcagtcgatcaataaaatacaagttttgtctaaattctgctttacttgtatttctcaattttgatacgtagtgcttcctttggcaaacagttgcaaatatatcttaatttgtttatatttttaacccccaaattatttgtgttttcttagtttagggatatatgatttttatcaatttctaattttattatatttaatttttgctataaatgatgttgcttttagaaatgcattcaggctttctttgtagtcctggacatggctgatcattgcaactaattctgtgtgtgctttatttttgttgggtattaattttgagcttattataatgttcaaatcttgtttgggaatgacgttaaaatctccagttataattgttgacatgtttttctgtttctgacagtagttcttcctgttattttttaacataatgggatactatatcattttgatctaattttcttcttggtagtatacaatgtcatttttttaacttctgatatttttatttgaagttctactttttctgatattaaaatcataggctttaagaattgagatcagctgtgaacatgacttaggtaaaactatgaaccagttatgtacacatgacttagttgtttcttctaggaaacattagcctggaaaagataagactgcaatccagtatttaaattcagtgtttgcttcaagaaatgctggcaaaacaatatatcgaagataataatattctgactctggtaaacagcctgcttattaatgacagttttcttacccaaactctcacttacagatgttaactgatcctaaactactagatcatgaacgttgcccaatcttactcaattccccactttgaaagacccaccttaaactactcgtgtccagactccaaagctctacaactattctgcttctgacttacccaagacaccctaagaccctgtccaggtggcactctcccttactgctgtaggttcggctaaatggaacttttgtttattgaaaacttttctactgatattttcgggtgtacaacaacttggaggtcccattgaaatccttctccctagtagctcaagcaaagatcctaaattcaaaaatagtgcaaatcactgaggcctcttgagcttcctggcttggtggggggaatcactctgactgcaatgaagggttatgtcttctgttagatttcagtcccagtttctttttatcaagctaccaaatgctaaaagatctcctttcaagaaccctttgattatttgatcagacttgaacaaatttatcctcaatagatatctgccttattactattgctttttatccctgctgccttcataattttctcatgggagtcaaaaaaaggaagttcataagaaagagaataagcacgggtcctgttaagtcaattcactgagccatcccttgggactagatgcccagaaggattggtattgactagacagatattgccataaactttatcaaaagcttatacaacgatttgaagtcttgttttgtctgtgagacactgattttgaatgagatctcttggtcaaactttccgtcttcccaaactgcacatttatcagatttgccactggagattacctaacctttagtttggggagccaagggcatgaggtacacaaacaactcatttgaccacccattgccagatcattttgcctttgtctcagattaaacccaagttcatatcccctccaagccatattcctgcctcctacatgtattttgcactataactgatactatgtatctctgtctaaacagcttaattttaccaacattaatttagaatttcagaggccatttgagaaaccttttgtaagaacaaaactgttcatttgagaggtgccttatggaaagagagtgaaattccaaacattcaatgatatgtatgttctgattgatataagaagtcttacaataaaaatacagattccacaattgcttcagtaattgttccacggaaggcgcaaatgaaaaaatgtgaaaagctcttttttagatctgcccaaatcaccacttgactcaaaaagcttttacctttactattcctgttctctcacccagttgccctccaagttccccttccctgacactctttctgatgtcccttttcttctggccagctagaaacactaaatgctcaattggctcttaaagttgaccaaatcagtataagctcattatggcagattttaagccctgggttgggtctaaggtaaacgtcattttcaaaaacttccaaagtctatgcaaggtaggtataaatttacagagaaatttgcaatagttctaggaacacataattcagggttcccagatctctatcaactgatttataggttattatcaacctcaaatgcaacaaaatgtgttggaaaaggcagtgtgaataccttgagtatgatttaagagactccacatttcagagtaaaaccagaggaacttaaaaaagctataaattttagacaaaacttttggagtttatgcaccaaaacaaaaatgacagcattggaaacctcagggggatgctccatcacacctatagaaaacattcagatgtaggtcctggaacatgtgcagtgccagctcttgcttcactttctctgagtggcctaatgtcagaaatagggaaatttaacatacaagcaaaactggaaaggaagatcatcctgttgctagacctccaagccctcacggaatgaaactaaaggggaaaaaaaggaagtaggaaatcagtgacgctcttccaaatgagggtcaaggactcagtttcctatttgcccttaaatgctcaaggagaatttctgtgtcttaaaaggtggtcttgtgaatgtttgatcctggcactatcatatcaaccaaaagacttgccactgtcacatgacctctttctcagagttaaacaactccagtggtggctatctctaataatccacaaattctccctgttgcatactgtgcctgtcatcttcagaccttaccgaggaatgttcttcataatctgtcactttcagaatggcagtttgttgtcaccagtggacctcaggtggaaccttgcaaacatttttcattaaattttccacctcaagaaggacaaattgatcactgtactttgtcaacattggtagggtaattttatggaggttgctgagaatgtctccagttgctggtctcttctgcaccagcgtaatctagttaaactgtaaaggtggaggctggacaagaactcaagtgtcagggtacctttgaacccttacaaatgggtttcatacagtcacctccttggtatggattttgaatatcctagtcaatgtttgctaatttccaaagtgagaggaaacttttgtctgttagaaaggtagattctgacagtaacagctcgccctttgaagtttggatatttctcacccaatttagggctctaccatactttgggcagacatggcaaagcaccacaagggactcacacaatatactcactcttatcaccaacaagtatggcttgcattttcttcatattctcccaaggaatcttggcacgacctgaaaaacaaagactttgtcatctggaaaagacagcatagaaaaaattcctagaaaccacattggaaagaaatagcagataaatttgactagaacagcagttaaacttgagggtatagatgcttggatttatgtctcccagctaaaaagacacaaagtttggcccactgacaaaaggactgacattccattagaagattgaaaattagggattctaaagtatttttcagaagccagtggcccttggaatagagacagcttctaccacgaagctttgtttcaagatggcaactgcaggatgtggacagcttccactcaagacttacaaagacttacaaaagtctttgaagtttggatatttcttacccaatttggggttctaccatactttgggcagacatgacaaagcattataagggactcacgcaatatattcagtcttatcaccaataaatacgaactgcattttctttctttcttttttttttttttttttttgagacggagttttgctcttgttgcccaggctggagtgcagtggtgcgatcttggctcaccgcaacctccgcctcctgggttcaagtgattctcctgcctcagccttctgagtagctgggattacaggcatgcgccaccatgcccgcctaattttgtattttttagtagagatggggtttctccatgttggtcagactagtctcgaactcccgacttcaggtgatacacccgcctcggcctcccaaagtgctgggattacaggcgtgagccactgtgcctggcccgttaatcccagcactttgggaggccgaggcaggtgtatcacgaggtcaggagattgagaccatcctggctaacacaacagtgaaaccccgtctctactaaaaatacaaaaagttagctgggtgtggtggcgggcgcctgtagtcccagctatttgggaggctgaggcaggagaatggcgtgaggtggagcttgcagtgagccgagaatgcaccactgagctccagcctgggcggcagagcgagactcttgtctcaaaaaaaaaaaaaaagaaaaagaaaaaaaaagatatgcagacttacaaaagacttaacaaaatttacagttttacaagacttacaaaactagattttaatggctggtgtttttttccttctatattttctttcatcattgaaggctcaaaagtctgggtagttaaccaatggttgttatttcttacccagtaaaaattcatgttctctaacttgaatattgctttctgtatctttagtcattccttgatatgacaactcagatatcaagagaaatgtatgcatgatgtggccaaaaccaacaatcaagcacacttttccctatgagtgccaacctgctagtaccaaccgtttgttatgaaatacttgatttcgttcataactggactcaaccactaactgaatttttatgtgaaagagaacacaacagagcaggtaaccaaaatcaaaacctccctggaaagaaaggtttctgcctccactgaaatcatactcaaggatcctttctcaaagataacatctgcaaacaaactttcatggagaaaagcctcagaaagggaacaaggaacagatggtttgtatttaagatctgactcagatttacaaaccttacaatgaaggcttactatggaagtaactcttttggttgtctatcatatataccctgggtgacctttgttgaacctctttttgtcacatagggtttatgtgaatactaaattagttaatatgtgtaaggaacttaaaataatatttagtatctagtaacctctcaataaactttggataaagcattaataattgtagatgtgttattgtgtgttattaatatcatgtctgatatactaatctttatttcttccttatatttacgacattttttctgttgttttacccttgtatttaagtgactattcaaatggtatcagatttgaacattgactttcttttttaagcaacttgaaaatgtcattctattgtattccctcatcaaatattgtaccaagaaatctaagcataataatagtttatagccatcttatgtcccttatgtatctgactgtatttttaggggtgctacaaattctaatgtatttgttactcccccaaatcttatgatatagaaattattataatctatattatgtcaacaagaaaactgagctatgaagaagttaagtatcttgtttaatgtttcagagctagtttttgactgagcctaaactcaggggattaggcactgccctctccttcccctttatgaatataaacatgatacttttccttgttagatggttagccattcttgttggaaaattttagaacattttctttgttttttattatattgaattttaccattgtttgtccatagggaattattcataacttctttagcacagttgcggcccttttaatcagtgtgtgtgtgtgtgtgtgtgtatgtgtgtgtaatttcgaagaaattattagtcaaataatctatacaaagtatctctcttgttatagttctctagaatttcttgcatacagatattgacatttttacctttataataatagcttatagccatattgtgcctactctgtgtctggctatatttttagggatgttgcaaattctcatatatttagtactccccaaaatattattatatagaaattactataatctctatatatatatcaacaaggacactgagttatggagaagctcatgtgttaacttttcttatattccttctgtctatccatcctttcctaattgcatatggagattcagttgttccagcaaaatatattgtaaagactgttcttttcccactgcatttggacctgtgtcaaacattcattgtccatatatgtatgggtttattctggatatctattttgttccattgatctgtttgtctgtctttagcccaacaccacattgtcttgattacttaagctttaaaatcagtcatgaagttgtctaatgttagtcatccaatttgttaatttttgccaaaaatattttgaccagtgtagccaaacatatgtataatatgtatttctatgttaatttcataaccagcttataagtttctaccaaaaaaagtctgctgggattttgataatgatcaaaacttgatagaggtcaatttgagtacaattggcatcctaaaaatattgagtcttctgattcatgaacaaggtatatcttgccaaatatgtaggtcctctttaatttcactctgcaacattctgtagttttctttttacaggtcttatatgtctttgacagatttgtcccccagttttttataattgtttatgctattgtactgatttttttttttaattcctttttttttttttttttttgagatggagtgtcactctgtcacccaggctggaatgcagtggcatgatctggactcactactgcaacctctgcctaccaggttcaagtgattctcctgcctcagcctcccgagtagctgggattacaggcacacaccaccacgtttggccaatttttttttttctttttgagagagagacagggtttcactatattggccaggctggttccaaactcctgacctcaagtgatccacccgcctttgcttcccgaagtgctgggattacagacgtgagccactgcgtcctgcctaaaatttcaattcttgattgctaattacaattgatttttgtatatagatcttgtatcctgcagcctggctaaatttacttattagtgctggtagactttttgtagatgccataagattttctaaatagctgattatgtagtctgtgaataaagacagttctcgttcttactttccagtctggatgcatttatttttctttcccaattccactggatataatcaataaaatattgaatagaagttgtgagagtctgcatctgttgagatgatcatatagtttttcttttttagttgcttaatatgatgaatcatactgattggtttttgagtgttaaaccaaccttttattgctgaaataactccaagagtttgtgtagaattggtgttattttttcctaaacatttagcataactcaattagctgtctggacctggagttttctttgtggtaagatttttaactgtaaattcagtttatttaataaatataagtccattcagattatttatttcttcttgaatgagcttttgtgttttgtacctttcaaggatagcttttattttatttaagttgtcacatttattggcataaagttttttataatataaccttattatttttaatatatgtggaatctatgatgatgtcacctctcttgttgctgatattagtagtttaatagcttgtatcttctctctccccaacccctatcagtctggctggaggcttatcaattttattgatttctcaaaaaactactttttatttcattgttttttctgattttttccttttttttcctactccattgattttggccctcatcattattttttcttccgtttgggctgggattaactttatgtatttatatatttatatttacatatacttatatttatatgagccaaaaaaaatcaaggctaacaaaagtttaaaagattcaaggtaattttacatattttacaaattttcaaggtaaatttacatatacttatatataaatatatatacttatatatataattaaccccagcctaaacatatatatatatatattttagtatccgaacacaaacaagtcactgatttgagacctttttcatttttagtgctgtaactttccttctaagtactgatttagtaacttaccacaaaatctgatatgttatgctttaattttcattcagtaagaaatactttctaatttgccttttgatttttttctttgacttgtgggttacttataattgtggcatgtagtttctaaatatttttgaatatcctggaaatccttctgttgcttctaacttaattttattatgagcagaaaacgtagtttttatgacttgaatcttttaaaatttggttagccttgattttttggctcagaacattatctatcttggtaaatgtttcatctgcacttgaaaagaatgtatgttatgctatggtaggatggaattttctatacttgtcaattaggtcaagttgatgaatagtgttaattcttctataacccctctgaccttctgatgttctctctgtatattccatcaattattgagagagagttttgatatctcgaattggatttatccatttcttcttgcaactgaatcagtttttgcttcatgtatctttaatctctgttaaatgtgactatgtaacatactgttgggaaaagaagatattttgagaataaaaaagggctataatgataattacactggaacaataggaataaacccaaattgtcctgagagcatatattcaatccatgttgaaaatggtggtgaaatatttttctcttgcataatagggcctgtgggtaagaagtacatgctgattgtggtggctctgctttccccagggctacagggttagtaaggctttctgctttgccacatggctcctatctcaggattgcctcatgctcacaagacagaagacatcacatgcagggtctagatttctcattctcacttaccattccatcactgaatcccacatatgttgcttcttcaaactggcatattgaacaaggaagatttgtggtgtgtaactagaaaacaactgtattttttccctaccacatactcacgtttacttttgccaattgaatcaaaattatgatgagcccaatgagttgtttaattattcctaggtgataaaaagtctccctgttccctctagacatagaaacagtctgagttttgtaatttattatcctaattcagtttaacaataatatctgaaaaagaattcctgtctttgctaaaaatcacagcttttatcctctccctaatggtattaaagtctcaccaccaacaacagaaaagcagtagttctcattgttttactttgctacccctccacctccttttgctagctaccttttctgatgccttcaagtcactgtaagagaaagaaaaagaggaaggtagaggggcaaagaaataggaggaaaattacttcctcacttttactattactagcctaatgctgtgccttcggtattctttaattgaaagcacagtattaggctagtaaaagtcaggaaataattttcattcaggttgcagatgtttagagctaactctcttggattattttggttttctgaaaaccctcttatcactggaggtattacacctgcagtttgcttgaactgcatggattcattaattttccaactgagggcttatgccatttctcagccagatcacatagtgccgtgtaggacttgttaaggatatgaattttagggaaattaatgagaagtcaaacattggtcctagaacggaccaaggatggagagtggcataatcaaacttacacttttaagtgaatacactgactacagtgacaaaaatagaccggaagagtttttgagcaaataaaagtcagaatacaattgtgagaattcagtccagagaggatcataagtttaatgagagtactggcagtagatgtggaaataggtggatagactcaggagagttaaagtttacagaattgtctgttttattgggcataggaatgaacaagaagaaagttgtagggctaaatgtcacgtttaaagcttttgccattggattgatgggagcgccattcagcaagatatgaaagctgaataggaccaagttatgcagggagattgcaagttccacattagatatgtggagtttcagttaccagtgatgcatccacatgggaatatcggatacttagccgatgatataatagactggagcccagaagaggggcctggtttgaagacacacatttgagagacatcaatgcatgctaattagagctgggggagtgaagctaattatcctgagagaaggaataaagagaatggaaaagcctgagaccaatccttggcaaacactatcataaaagccaggaagaggaggatgagcccacaaaggcatgtgacaagtggactaggagttagaaggaaagctgagaaactgggttgtcccagatgtcaaaggatgagagtagaggaggatagacgtagccactggcaatgtaaaatcctgccaattaagtaagatgagctctggcaaaaactctctggatttctctgctgctctcatttaaatattttgttgtaatgttggacgcataaggcagattgcagtaggttgaaaagggaaaggaaaacaaggaaataaagacaatgagcatggaaaatgcttttggaacgaaaatacgaggggaagggttaagtggtagctggtgtgggaactgatgtcaaatgttgatatattcatctttaattaaatatgatgtgtgcgttgcaattatgtttttaaagaatatggactttcatgggcagatatgcaggataaagtgagaaataaaataggaatgcactcaaatatacatatataaatattattctaattgttaactgtacaagcaaagaaaaaatgactaagaaaatacagtaagtttttaacagtttatctcttgaaagtaggttggagaatgactttttcttgtattgttctttgtgtatttcacaaaatatatacatagttaataaatactaaatcaatatatactaattgtgtatatacagtacatgtatattatatatagtatacaggtatatagtatatgtatacatatgccatatatacacactatatacttatatagagaatatgtactatatacatatatacattatatacacatgctatatatacatactatatacatatatagtacacatatatactatatataatgtgtatatatagcatatgtatagagtatatagtatatacatgtagattatatgtatatactctatatagatatatatatgtatatactatatactcttatgtatgtatatatatactctatatgtacatactctatatagagcatattgtacgctatatgtatatactatatactctatacatatgtatatgtacagatatacatatatgtatatagtgtgtatatatagcatatgtatacatatatacataagggtatgtatgtatatactgtataaatatacatatcctatatatagtcacaattagtacatattgctttaacatttattttaaaaacattctttctctgagacaataaatatgtgtgaaattgctaacatgtatgttagaaataaattttcagtgccgcaaaagaaatagcactgaaacatgaattttctcagcaaggcaattttacttctatagaagggtgcatctcatggatggagcaatggtgagagcacacctgaacatgggaggggaaggggttcttattctgacacagatagcccctactgctgtgtcattcccttattggctagggttggaccgcacagtctaaactaattccgattgactgttttaaagagagtggggtatgagccagagtggcggggtgagcagtttcaacgggaaggatggttacagaacaggtaactaaaagtgactcaggtcagagtaggtgacgaggggtgactcaggatggagcaggtgaccagggaaacagatgtgaactactgattagaactggtggaaaggttttttactgaaactagggacaaggagacaaagagaacaaggaacttaaactttaaaatgaagaacaaaggacaagaaacttcacatactgacatactgattctttgaagagaaacttggaactcactgtatttaacaatgtagaacactaattaaagataaagctttatataaattcctgaatgagcataagcatagtaaaaactatagtaattttgcaagaagcaatcaagattggagggaaatgagaagaaataaccatgaaggaagtaaaaactaggcttcgcaggaccagtggggaattggaaaagcaagaccatgagaaaagagcaatctacatgttctggggaaaggtgctggaatggaggcagtacacagattggaattaaacacggtggagttgggtagaaaggtggagatgcatgtggaagcatgtaagatgacattgcaaaatgtggggagaaaggaagccaaattagagttagctgaaatttagaagacacttgatattgaccataagtttagttactactctgattgtaatgaccaccctctgataaattttaaacagtaaagtgacatgataagaagagcatttttgaagaatgaatttttatcattatttaggccagaacagaggtatgttaggagatagagaaaatgaatttaaaggtagagaaacaggataaaataatttccccgaaaacttacaggacagatggcaaagaactaaactaggttgattatgtgagtttgaacttaaaaaggattgctagagactatgagtaaatgagggtactgttccttattgaagatctactatgtgaaagtgggagaaatcaaattttcacaatcatcatcttagtttctcctagcaatccagtggggtgcttattacgtttcctatggatgaggaaacagagtaatattaatattcatttggctgagttcatactcttctgcaaaacttaggtgtgtatctccagaatttgtcttatttttctactcagcacattatatagagccctgtgaagacataaaagtcaaaccaaagtatagagaagtagggagaaataacttttggatctgttgaaattggagtgcagcaggatatataggggaccacagaactacttttggttagcgtccaagtctttttcattgttttgggtttgcttttttttttggcgggagcaacatcaataaactaaggtataccacacacacacaattcagtagctttcttaatgccatttctggaattcaagccaaagattttaacccaaaaatattgatggaaattccttcattcctttattccttctttcttcccttcctcgttcccttccctcctccctgccttccttcttttctacccatccactttcctcctttccagcctccttttttcttgtataactattttcccttatctgactgtggagcccttcttctatctattaatgatttctatttctccctatttttctaagagaatttatggcagtttataatatgacagttttattgttgctttatattattctgttgatattgttttttgatatacaaacttttttttcatatttttatgaagtctaatgtgtctttttttttggttgtctgtgcttttggtgccatatcaagaaatcattgccagttcaacattgtgaagctttttccctgtgtttaattccaagagttttatagtattagatcttatatttaggtctttgatcaattttgagtaaacagtatataaactaaaatcaattaatattaataaaataagattaggataataagatgaagaatgactaaagaagaagtaattaaaagtacgtgaaattaatgtcaaatatatttgagtgaattagtttatcagagatttttatgtgtagtcatccaaatggttatttgcatttaaagataaccttaagttcatgacagagtatatttagccatctgttttttaataggttatttttaagacttcagttttaaagaaaacaataaggtttttataggaatttcattataacaaactggcacacatataaatacattgttgtttaaaattagaatgatttcatccatagttattatgttttagaatacagataagctgcaaaagaaatcacaggaaatgcctcttttctgaaagaacaccataaaacaccgtagataacatcactcgctttttgtactgaataggtcatttagagttgacagcatacgtgaataattacatttcatcttatattttctctataataatgaaatgtttagtaaaaataacatttattttgaaagaaattcacagaatattgcagtgtttaaaaatgacaatcatgtctaagaaggcatcaataattctgaatgtctataaagtagtttgcacaaaagtcaagctggtaaacaaagtttctttaaagttattgcatcaattttcataaggaatattgtctatagtattcctttcttgcagtgctttgtcaggctttggtatgaagtaatgctggcctcataggagttagaaaatgttgcctcatctgcaatttattgagaaagttttggaaggattattattagttatttaaatgtttgctagaattcactgttgaagccatcaagtccagaacttttttgttcaggagatttttgattagtgattcaatcttcttactagttacagatctattcacattttctatttcttcatgctttagccttcgtaggttttgtatttctaggaatttgtctatttcatctaggttatccaacttgttggtgtacagttgttcatactattctcttagaatccttcttacttctgtagaatcagtagtaatgtccccacttttattctgattttagcaatttaagtcttctccttttttcttagtctgtctagctaaaagctttatcaattttgtttatcttttctaaaaaccaacttttggtttcactgatcttctctatttttctattccctatttcactgatctctgcacctagctttattatttacttccttcttctagcattgtgtttaatttgttctttttctagttctttaaattgtaaatttaggttgttgatttgagattttttttgtattttttgataaatgcatttacacctataaattttccccttagaacttgttttgctgcatctcataaattttaggatgttgtgtttataattccatttattgaaattctagaataggcagacaaaactaatttaaggagagaatcagaacagttgccttgagagaggtgtaattgacaaggggaacataatcattgtctggaaaggtagaaatgttctataccataatggatttgggtctacatagctgtatacatttatgaaaattttacagctaaaatttcagtacattcagtgcatgtatcttacacctaaaatagacttataataatagtaattgtcattattcttaaccataacataattatcattaatactattgttgttgatattattgagtggcaggtggggaatcaatcaaagtatagatttaagcatagcagaacgtggctgcccatggtgggtcatgcctgtaattccagtgctttaggaggctgaagcaggaagattgcttaaacccaggagtttgagaccagcctgggcaacatagcaagaccccatctctacaaaaaaattttaaaaggtagcctggcatggtggtgcacacctgtggtcccagctactattctggaggccaaggcaggaggatctcttgaacctaggaatttgaggctgtagtgaacaatgattgcacaattgcactccagcctgggtgacacagtgaaccctgtctttaaaaaaaaaatagtagaatgtttataaatattgaagctaagtaatgacaaatgggtattcattatattctgtttaccttctatggtatgatctaacataaaacaaaataatgaaattaataatctaaggattaactctccaaaattattatgttatgatattccagaaaagaccacatacacattatatacaaatccatctatgcttcaatcagtattttataaagctaatctgacccttgggaaagttctagagtaagctgtttttattactttatttcccatttatgtagactagtatacagtacaaactataacaactctgaatggttatgccaagaattattaaatgtatcactatccctcaagccttctgagtgccacattctattataaatgtgaattcgattatactttcttgttccttacaattcataatgattgctgcctgtgtgtaattatattaaacatgatttcaaattgaaactataattctagtttgcaaaatgtaagagtttatgtctcatggttttcaattattcatgttatacttcagccacagtccttacttgattgtaatctaccaatctcacctcaaataaaattgcagacataaagtcaaaacaagaaattggtgtattatgaaatcataaaacattaatgagacatgatatctgcaaaacattatgaggtcatggttattatttataacttcctccatctctctgtatttcacatttgctttgttctcagaaaacattgtaactggtcaggattcaatatcaggtaatataacctaaaccttcattgccaaaaattctgagtgcttgctggtcctatctgtgtggagttgcagtacccatcagtgaacgtataaggcagtactaagaggtgcttgtacaacctcaattctcaaagggtagtcctccaacaaacagcctgagcatcatctaggaatttgttagaaattttggatctggccgggcgcggtggctcacgcctgtaatcccagcgctttgggaggccgaggcgggcggatcacgaggtcaggagatcgagaccatcctggctaacacggtgaaaccccatctctactaaaaatataaaaaattagccgggcgtggtggcgggtgcctgtagtcccagctactcgggaggctgaggcaggagaatggcgtgaacccgggaggcggagcttgcagtgagccgagatcgcgccgctgcactccagcctgggcgacagagcaagactacgtctcaaaaaaaaaaaaaaaaaaaaagaaattttggatctgatgccccaaccctgacccattctaattaactctgcattttaaacagattctccaggcgattcctcattaatggcttgtcaaacacttcccaagtgtagataatcatttgagtctttgatactgagttctgtgactctattttatagcagcaatcgtgtttcccctcagtaatccttatatatcctaacgaacttggtagcacctgatgatcacatttactattatatttatgagacattcatgcaaaatggaagttaagggtgcgtccagtcaaaggcagagtaggacgctctctaggtggagagaattgaggggttgataaaccctcaaatattcccactgtgctacagaagcttggcatttcttttaaggcaggggtgttgaaagcaaccatactctgcataacgccagggtgctgctaagcatcttctacagccactgtgtacggtaaaaggcaaagctaacagggctggactctagagccccagtgcttcaactggggtaacccctactgtgtccatgtgttatattagagattcacttaacttttctttggaaaaacagtttctgctaaataaaattaaaaattgaaaatctctaggttggcatatgaccaggaggtcatcaaattacatacggttctcaggaaaggtaacatattaacccataatcatgtactgcttccgagaaagaatccattaatcaggttggttacttgagagaacagcgtgctaaacaattaaaaccagaacatttacttttaatggcttgataaaactgacccaattttaatatgtaataagaaaacttggacagtcagataattatttgtgaagccagggaaatggaaagaaaagtattgattaagaggactatatatgtgtatgcatgtgtatcaatatagatatagatactgaatttcagatttttaaaaaaactaaatttcctccttttaaaaatgttcttttgacttttttatttagtatatattgtgtaatggttatcacaatcagattactgaacacatcctgttcatcttataactgaaagtttgtctcctgtgacggacatctctccatttctctcatcccccagtccttgcaatcattgtaatactcttagtttccataagtttgactttttccacattccacatgtaagtgagatcatacggtgtttgtctttctgccccccgacttatttcgcttagcataatggcctccaggttcattcatgttgtcacagaaggctgaataattcccttacgtatgtgtgccacattttcattattcattcatccattgatgcacacttaggttgcttccatatcttggcttttgtgagtaatgctgcagcaagcacgggaatgcagtgtctcttcaacatactaatttccatttcctttggatatatacccagaaatgcaattactggattatacgatgattctattttttattttttgaggaatattcttactgttttttataacagttggactaattcatattcccaacaatagtgtacacggatttccttatctccacatttttaccaacacttgtaaccttttttctttttatagtagccatgctaataggtgagaggtgatatctcattgtggttttaatttgcaattctggtgattagtgatgctaagcattttttcatatgcctgttggccatttatgtatcttctttgaaaaaatgtctatttgggtcctttgcccatttttaattgagttatttggagggtttttatttttgttttttttctttttggctattgagttgtctgacttccatatatattgtggagattgactccttatcagataattggcaaatatattctcccattccatagactgcctttttattttcttggttgtttcctgtgcaggttttttttgtttgttttttctttcaatgtgctttattaaagtgtctgtaaagattgtcaccacaaagaaaaaggtgactgcttcagtgaaaaaattccatgaaattatttttagacaccatatttttctttttaatgggggaaaatacatgtaaagaaaaaatgagtttgtgtgattaaaaagagagtgctgtttcattctttgtgactatgagccatgcctaacagttaagagagttattttaaaacactagatgtattggaggtcacagctcaaaattggctgacatcctaaatctctgatacattatatcactttacattgcaggctatatgtttagtaatatgtattatttaaaatattaacatttaaaatttttatcttaatacgtaaaattacctgtaacataacctatgacccaacttgacatcctccttccaggtaagaaagaatctgcatgagaacatagtcagggaggtaagggacagacagggaactggggtcattagagtagtgtcgattatagtttcactgtccaactgtgtaatcccacgccaatccatgcccagaatcaggcaagaagtgggaacaaagtgtatcctcagtattttgtcctagctagcacccatgtactttgcttgtttgtttgttttgttttgttttgtttttgagacagagtttcgctcttgttccccaggctggagtgcaatggcgcaatctcgggtcgtggcaacctctgcctcctgggttcaagtgattcttctgcttcagcctccagagtagctgggattacaggcatgtgccaccgtgcctggctcattttgtatttttggtagagacagggtttctccatgttggccaggctggtctcaaactcccgacctcaggtgacccacctgcctcggcctcccaaagtgctgggattacaggcatgagccaccatgccctgccacactcatgtacttttaataactttatttttgttactgtatcataaggctacatatcaaaactataaaaatgaatagctctggggtttgtatgtaccagtgctcagtaggaagaaagaacaaagagtgattatctggaatcatttaaacttctagcccagccctgtgcatagaaatataatgtaagccacagatatgagccacagaggaaattttaaatgttctagtagccatcttaaagaaaaataaaaagcagcaggtgaaattaattttaaccgtatatttcattttatccaatagatccaaaatattttcattttaacctgaaatcaatataacattactaattggatacttattttgaagtctttttaattgtactaagtcttaaatatctgggatatatttttagttacagcccatctcaattcagacttgctatgtttcaagttctcaatagccacatgaagctggtggccactacagtgcatagcacagttctagaccattattctccctcccctgcagtacagcccacactatttagccacatttctttttctcactaacctatactgtttcttaaggaagtccacactaatcgatcgctttgcatacccaattaattgatgtttgcataccaaatgcactacttcatctttaactcttgcattagctacatcatttaaatgtttatgcagataagcaactcacattttgactttcagttccctgatctcttcaaatcaaatgcatttcctctctcttcagctttagtcattccatctgaagaccagactatggactttgcattcaattgcatccattatgcctctcaatgcttatgtttttgatatggttcactcagactacagcctcccacactttcactttcagtgtggccagtctctcattttcgctctttgactacattgaggccacagccctctaatcctctgtctactccctctagaccctttcttcttcctagtcacatttatgtactaaacacggatggcagaagtccacagagcctggtctgaggatggtctaaggaacagatgtcagcagagctgaaaaccacctctaggatatggtgttaccttagatcaggggctttgcggtgttctttgtgtttcttgttaccagtaggcccatgatagacctgttccacgccatttcacttcaaagatgctcagacatatgtgcatgataggagctgataggagcagctcagcttggttccaagctttgacactgctacgtgcctctgtggacccttccagggtgattctatcagcctccatggctttaaatagcatgtaccctgttagctccagtaccagcatttccagtcctgtctttagcttgcatacttcttgtctctttcttgatttttccagttgttattgtcttctccctgctcttctcctcacattgtctcccttttttaatgtctttactatcaagttcaacaaacagaaaactgggagctatccccctcccagctttatctcttcattccgtatatttaagcaaccaaattctggtacttctacagaaatcactcttgaatttctcccctgttctctccattcatagtcagcaccttagttcaggccctgacctttatactattacaaatggcatcggtattggtcatcctgagtccaggttgcaaaccagttgccacagtgctgttaacatactcttgtaaattgtaaagctgattatcttatccttacgcttagaatattttatccactttctattgagtatatcagaggctttcacatgcatcattttagagcagaatgatttttagaaatgaaattagcagtgagtttaaatatacaaaatataacaaaagtagcagagagcctcaccagaaattaaatttgtgagaatagccccttgatccatttttaagacagaccatgccagaaaatgtctatgaccaattgaaagcatcccattgatgctttagaaaaaaaggggagagttaggaaccctggaatcctcagaagaatgagtgcagggtgcatggacctatttttcctgaagataatgtgtgttaggttttttatacttctgtggtttaaatggaaactatgattctctcctaaatcaactgctgggaactggaggggactgtgtatcctagatccttgaggtgcaatcctgccccaccctcatgaagtcagctgcttctctggcaagggttgtgaaccatatttctgtaatgacaaactatttatttttagtttttcaactctcttttagtaaacattgaaattattttatcgtctcatactatgagattatttcaagttttgcttactccttccaaagattttgagaaacagttatttttagtttacatagagaagaaagtcatagattcttaaaaatgtatatgttctatctgtcagcataatcttccaaagtttttttgcccgtatggattgattttgtttttgctgactgaactatcaaaatggccccaacaattgtgaaagtatacaaaattcaatttcgaatgcattacatttacagaactatttccagaaaaacagaaaatgtcccaataaaaagtattttcaaatgaaaaagctagagtttaaatatatatccttaaatagataaaatttaaagaaaacattttatatatatgattacaaaattgggccaaagagatagtttttttataggtttacatttatattggaaattcatgcaaattttctaaatacagttcatgactttttgctgacattttcagttatggtcactatgtttaaggaaaatgaaagcacgtgaatgtagaaggagtatgaatatagacaatttcatttcttctggaatgttcttgacaaaattgaggtggaaagagagcaggagtagcctttctgaaagtaatatttgctatccacctggtatttcattttaaaaatttaaaataagatctctttatttaaagttattgttgctgctgctgttgttgttgctgctgttatatctgtaatctgccagcccaaagcaagaaattttggaagttgacaaaggtcgcgatttcttcactccagctacttcctggtgtacagaacaactcaagatttgctgggaaaagctgggagacattgcaaaaaagcacagaaattgtctccctgtgaaagaaaagatcaagatcccatttcctcttccttctgaggtaataccaatagagatgagtaagcaggaaagtttaagattttctcatggggcatctcatcctgatacagacctgaaactgacaaccaggcacaatgccaaagcctaggttgttgtggggaagggctgcttgtgggatcaatattcctgaagacaaaaatctctctgtgttcaatctctaatccactcgcccaatgctttgtgcttaacaggcatgcacaaataattttttttagtgtaaaagtaggaatccaggtatctaaaagtatggaatgactatagctggatgtaacattggaaaaggaggatcaaggagatttgcttacctttcccttctcccagagttatcttcaacaggccttgctagatcagtagtaagatgatgagacttgcagagcagtgagcaggaaccacatgcaatactctttgcgtgcaatggtggttcttgctccagatcttccttcctgtagtatttggaaccagtactgcctgcacatcaagcttgcatggcaatgatattttcaggacattcctctgatgcatccatgctgttggtagtggtacgtaaagctggacttcttattggtcagccttggagtctccagcttggcaacacttgttcaaaaataagcaaccagcatctcatgacactttgctgtcctccagcatcaagatgatgctcctgaattctgacaatacctctacttcaggagcagaaatgcctgaattatatgatcaacgttcccaagtaaatgggattatcccaggacatgtaggttcacattaatgtaattagtaaaagaactgtaatctttttggcctctcaagctggtaaagcaggaaatcaaaactctgttcatactcttacaatgtgaatttcattattgcatgagaccatgctgtttattatgaatttatccaagaagagaaaacatacttgacacaatagaacatgctaaagaaatataccaactttctcacttatctggacaaattaaatccaacttgcaaacttgagttgtgaaatataataataataaaatctatatgaagtttaagaacaggtttatttgtgattagaaaatgacagaaaattcagaaaattaatttacctatcagtattccttttatatccaattaatttaaaattgtatattctgtgataggaagctagtttgtacttgtagaatatactatataatccataaatagccatgactttttcattcaaaaagattgggcattgagtttgctatagaattttcatattgattttaaataaatattctaaaataagatatgagggtcttatcccaaagaaaatgaattttaaacaaaagcatcaagtatgccttgtcttcaagagaaaaccactggattgcaaaagtggatatagttttaatattggcctttaattcttcctataactgtttggaaacacagtacgcctgccatcagtatccatgctatgtgataaatcaaacagcaaaatatgtgaatgtgatgtgtctgccttttaaatgactattctgttttccacatttctgtacacagaggaagtagataaaatgtcacctgtagctaatcatgaggatgcattttattgaatacttctatggtagaatctacggcattttctgctgagctgctatcaagctgtgttagggtactggatctaccaattacgtttatgttaggttacttacaagggtagcaatacaataaaacagtgagacaaggaaagaagaaatctctgttgcctttgctccttgagttagtaaaggcaaagaaaaagtgaaattcttgatagctgtctgcactgaaacatttcagctcaattctctttcccaaagatcaagtaaagaaggctaatcttgttttctagacacttaactctttttcttaggcatctttagtccttattttgcctgagagcctcttaaagggaatattgtattttaaagtgactctttagtaatacaaacacaatagtcccgaatacatcagtgtcacagtaatcgtgttcagaagttcacacaagctgaataccagaaagctgaatgcctttcttcccagtggcatgaatactcacaaggcataccattttagtggcaaattcactgctatttcatctacagaaatgatcacaagacaactgcgataaatgggaatatgaaaagatgtatcaaaagtaaaaatagggccgggcgcggtgtctcatgcctgcaatcccagcactttgggaggccgagatgggtggatcacttgaggtaaggagttcgagaccagcctggccagcacagtgaaaccccgtctctactaaaaatacaaaaattagctgggcatggttgtggatgcctgtaatcccagctacccgggaagcagaggcaggagaatcgcttgaacccaggaggtggttgttgcagtgagccgaggtcaagccactgcactccagcctgggtgacagaccgagactccatctcaaaaaaagtaaaaaaaaaaaaaaaaaaaaaaaaaaggaaatggaaaacatagccttttcttaacatttatcaacattagtgttgttctatgaaaatttagatttggcttactttgcttatcagatgagtatgcttatcagatagccatttcactaccaatgtgtgggatcttagattctagattaatggcccccaattcctaagtggcagagatgtgccaccagacctcttaaaagtcagcaaacaagagaaggccatttcctcctgtaaagcatgtgtctctctacacaacatagatgaagagcctgttcaatgctattataaaagataattgccatctttacttaaagttgaatgataaagtgaaataaacaattcatttgaaagattattaggacctcttttatcaaagatcagaggctttggattatggatacctaaatttgaattcgacctctgcttctgatagattttgtggctttaggaatatttgttccccttctttagaaagcaggactcagggaagagaccaaactttgaggtcatttaaatgaccacctgtaaaattcctcagacaccaaaaactgttgatccgtgattgtttgtacttttataaatttttaaatagaaatattgaatcgtattatatcaaataaaacattatttacttggcatcatgatgtttgtaatagtgttctaaaaattgtcaaatgatatataagatgagttattattgctgaaataacaaattaagtacagtgtcttaccttgggagagccaaatccatcaaagtcccgggtgatgatatagcggagcaaagcaattctgaattctgggtttcagttgcctgggtttgagtttcaattctaccacttgccatgcggcagatattggacatgttacttaacctatttatacttcacttgtttcatctgtaaattaggaataattctcataaaactaaatcgtgggctgttatgaattaatatttgtaaagtacttaatatggtgcctagcacatagtaagtggtttgaaagggttagataaatataaaacattcaacatcaagatgtctggaaactaccaaagtggtacatttgaattttaccgaatcgattttagccctaattctgacggagttgatgtgtggttacgatcagaatagtgtttagagtgagttgacccaaatctgtgagtgtggggtaaaaaatgggtcagcaatttgggacacatgaaacaatcagtgagaaatgtgggatcaggataagatgcaaagtggcaccatctgaaaccaaggatgcagaagagtgtaagtttataagatagttttggagctgtgactgaaaaactaccactgaccagtcctctgtgccggatgtaatggagccagtggaaccccgtcatagctgtgtagtcaccaccatgttgggatccctgaatctgctttggcctgatgtaccccagcaactcagacttcacaacctagctcctcactcctgtcttgcctatttagacttaaaggacctcccagcctgcgaatcagacaccactctcactatcaggttttcctggcagaaacccatagtagggggtaacatttgagaagaatccttaaattccctggagtatagacttggcccttgcctgctcacatcaataatgacacctcagttctaggaacttgtcaagaagtcactattttacttttgccaaaactttgctagagcaatgaattttgtgttaatgatgtttgggaatacttgtatataaaataagagtgcttgatgagaaggatgtctggaattgagtatataaatgtttatatgctggaaaactcactaattttggcaatcagcttaataattatttgcataagttctgtacaaaaaaaatggttttctgagggtcacagaaagctctcgtttttttataggagaaaaatggatacatagaaatagaaaatataactaattgaaataatcatccatgaaagtaatttagctcagccgggcgtggtggctcacatctgtaatcccagcactttgggaggccaaggcgggtagatcacaaggtcagaagtttgagaccaacctggccaagatggtgtaaccccgtctccactaaaaatacaaaaaaattagccggacgtggtggtgtgtgactgtaattccagctacttgggaggctgaggcagagaattgcttgaaccccagaggcggaggttgcagtgggctgagatcgcgccactgcactctagcctgggcgacagagtgagactccgtctcaaaaaaaaaaaaaaaagaaagaaaagaaaacaaattagcttacttagcaagtcaggactatactccacaaacaagtagagttctctataagaatttaggttctttataaaaattttatttataaaaaatgtagtcctaaagaaaaatttggtttaaaagtaatttggtgttttgctcttaaattgagggttattaattatgctggcaagaagataaaattgtttcaaagctggcacaatttttattctgaagttaagacctttcagcagagtgttcacattgctgttttagatgtttgcctaaaactaaggagtttgtggtttttgtctgccacagaagtaatataatcccgagtcaaattaagctagtgctatggtacttccttagttttaaaattcaatattcttgatattcatgacagttccctttttgagaactgattttctgcagttcagtgatactccataatgcctaatagatgcaaaggtaaatatggtatgtgcacatctaggcagtttgggctgaatataggaagaattcaagcccagaactaaaccactgcctttcaaagctgatgtcatagaaggaatgaagagagaaacaagtcagtttattttgcccctgccctgaccctcttacaccaaccacctggggttgagccagacctctcaagttaaggacacactcctctatgagactgcccacactccagatgccagctgcaagtttgaggttccccaggccaccttcactactgagcaaccggctacaaatttggaggttgccacaatctcttcacatttgattcactaaaataactcaccaaacttaggaaagtgctgtatttatgattatgcttttattacaccaaaaggaaattagaatcatccaaagggagagactcacagggtgagctctgacaggggccttacctgaagcttccattgtcctgtctttgtggagtcctagatggcattctattcaacacacacttgtgcggcaatactgaagagctgacaaccaggggttctcctgagcttcagtgtccatggattttattgggatttcattacatagatgtgattgattgaatttttggccatgctactcaatctctagcctccctacctccctcagggattaagctgttattacccaattcaaaggcccaaccctctaattacatagttgatccttctggtaatcccattctaattcatctaattagcctaaactaagagcccactgtgagtcatcttgttagtataaattatcaagtgttatctgaggggctcactatgattcagaaagacactcctatctcttaggaaattccaagaatttaaagtctatctatcaggagctggggacaaagattagccaaattctttatcatgcagccttatctagctaaaagtgtctgagtttctaaagaaatgggttcaatattttaatggtttttttcttgtcctatttctattaataatggcctataatgctctctgacccctacattcttctctaggtttcttagtagtgaggtctaacttgcttccttcctcctgggctctgaaactaaggagagaactagataatagaatggctgatacttacagaaaagtaccgcacagtaggtgtcactctaagtgctccacacttgtctctcagttaaatgatcacaaaactttctatgagataagcactattcctacccctttattgggatcagatttctctgcatatatcagataataaaaatacagcaaggctgggtgcggtggctcacgcctgtactcccagcattttgggaggccaaggcaggtgggtcacttgagatcagaagttcgagaccagcctagccaacatggtgaaaccctgtctctactaaaaatgcaaaaattagccagatgtggtggtgggcacttgtataatcctagctactcaggaggctgaggcaggagaactgattgaaccttggaggcagaggttgagtgagccaagattgtgccagggcactccagcctgggcgacagagcgagactctgtaaaaaaaaaaaaaaaaaaaaaaaaaaaaagcagtgacaataccaaccacaaccagtagcttaaatatatacatgtttcttttctcacacagaaaatgtgcagaggtagatagtccatgacggacagagaacatattcttcccctgctcctgttctacctttcattgcccttcactgtacataccaatatagctgttctagctccagcatctatatagaacagctatttacagtgaagctataaatagaatagctagcattctatttattgcatcagaagatggtagtgacttctccatttgaagagactttcccaaacgtccatgcagcatgcatacatacctctgactccctgacttacccagcaacttgattttgaaaatagaaagagaaaagcagtttgtcaccaacaagcagtttgtcacctacaagggatgcttaatatgaaaataacttctgattttgcatcaaaatctatggaagccagaaggcagtgagatgacatattccaagtgctgaaagaaaaaataattctatattgggtaaaattacccttcaaaaataaagggggaaatcaagatattttcagataaatgtaaaaatgacagcattcattgctagtaactttcttgctctgcaaaaatgctaaagggagtccttcaggctgaaataaaagaatgctatacagtaactttttttcctatctaacttaaaagacaactgtgtaaaacaatggttgtaaatctatattgaaggcacactgcatattaatacgtaatttgtgataatatcaacataaagtagggagattgagtggtataggagcaaagctcttataaaattgaaattaaattggtattaatctaaactagattgaagtcaaaatttgaactagattggtatttgtttgaactagataaaatcagggagagtgatgcctccagctttattctttttgctcaaggctgtattgactgtttggggttttttgtagttccctttgtagatccatatgaatttaaggatattttcccatttttgtaagaaataacattgcaattttgatagggattgcattgaattttgcatatcactttcggtagtagggacttttttcaatattaattcttccaatccatgagcatttgatatcttttcatttatttgtattttcttccatttctttcatcagcattttatagttaacagatattttgcccccttggttaagtttacatctaagtatttattgtaaatgggatttttctcttaattttcttttcagatagcccattattagcatttagaaatgctaccatttttgtatgttgattttgtatcctgcaaccttacgaatttattatcaggtctaaaatttttatgatagagtctttagggtttttatatataatatcatgttaccaaaaaaatagagacaatttcatttcttcctttcctgttaaaatgccatttatttctttcttttgcctaagatctggctaagtattccactaaatcaactcaaaatgatgaaaaacttaaatattcaggtcttatctgaaaccgtacaattactagaagaaaacacaggagaaaagcttcgtgacattcttctaggcaataattcttttaaagatatgaccctaaaaggacagtcaccaaaagcaaaaataggcaaatgggattacatcaaactaaaggctgctgcacatcaagaaaaacaaataacaaagtgaagagaaaatccacagcatgagagtaaatactggcaaatcatgcatcttataatgggttaatattcaaaatatgtaaggaattcaagcaactcaatagcaagaaaatatataacctgatttaaaaaatgggcaaagaacctgaacagacacttctcaaaagaagacacacaaatggtcaataggtacatggaaaaatgctcagcatcagtaattattagggaaatacaaaataaaaccacaatgagatattacctcagacccattggaatggcttttattaaaaagaggaaataaaacaagtgatacagagaatgggaagaagagagctcatacatttttggtgaaattgtaaattagtaccttttatggaaaatggtatggaggttcctcaaaaagcaaaaaatagaactactctatgacccagtaatcccgcttctgggtatctatccaaaggagctgaaatcaatatatcaacaggatgtccgttctctcgtgtttattgcagcctcattcacaatagccaagatacaggaacaatgtaagtgtccattaatggatgaatggataaagaaaatgtggtaaatatacacaatggagtagtattcagcctctaaaaagggagaaattctgtcatttgcaacaacatggatgaatctagaggacattatgctaaataaaataagccagaaacagaaagacaaagatcatctgatctaacaaagttatggaattggagagtagaagaatagttaccagaggctggggttagggtagggataaagagaatagggagttgttgatcaaagggttcaaagttttagattgataagaggaatcaattttaagatctagatctattccactgtagggtggctatagtcaataataatgtattatatatttcaaaataatttagagagtaaatttcaaatgtctcaccataaaaaatgataagtaagtgaagtgatgggcatgttaactagtttgacttaatcctaccatactgtatacatatattaaaacatcacattgtaccccatgaatgtacacaattatgatttgtcaatcaaaaatttataaaaataaatccaataatatatgcaatgtatatacaattgtttagccatatgtgaaagaatgaatttggatgcctacctcacaccattttacaaaaattaaccctataagtgtcaaataatacgttttaattcttatgtaggaattaaagctatacaattcttagacggaaacataggtgtaaatttttgtgaccttggattaggccatggtttcataaatatgacaccaaaagccatgcaacaaaagaaaataataaatacattgacttcataaaacattaaaaacttttgtcaaacaaatgacattattaagaaagtgaaatgactacctttagaatgggagaaaatatttgcaaattatatatctgctaaaggtctaatatctagaatataaaaagaactcctacaactcaacaacgaatggccaaatgactcaatttctttaaatgagcaaaggacttgaacagataattctcttaagaagtcctgcatggccgggcacagtggctcacgcctgtactcccagcactttgggaggccgaggcgggcagatcacgaggtcaggagatcaagaccatcctggctaacacggtgaaaccccgtctctactaaaaatacaaaaaattagccgggcgtggtggtgggcacctgtagtcccagctactctggaggctgaggcaggagaatggcgtgaacccgggaggcagagcttgcagtgagtcgagattgcgccactgcactccagcctgggcaacagaaggagactcggtctcaaaaaaaaaaaaaaaaaagtgtggtgtgtgtgtgtatatatatatatatatatatatatatatatatatatatatatgcaatgggttattatttaagcataagaaggaataaagtactgacacatgctaccacatggatgatccttaaaaacattcacttgtgctaagtgaaagaaaccagatgcaaaaggtcacatattgtatgattttgtttatatgaaatatctggaataggcaaatccagaaaataggtaaattcaaagaggcagaaagtattactcatggggtgaggggaggaggaatggggaatgactgcttgatggataagtgccttctttttggggtgatggaaattatctggcattagatagtgctatattttgagtattatgtaagccactgaaattatacactgtaaaatggttaaaatggtgaatttcagttatatgaattttatatccagttttttaaaaagatcttgctcagaagaaatatctttgctccaggacatccatctaccttctcagtccaaggccctcaccagcttcttttacattttcccaggaatattataacttttgagaaacaaactgcttttttaaacatcacactgctaaaaaatcaagaaagtgagagttccatgttttgcttttaatcggtataaggtatattgtgaagataaactaaatttgaataattctgaataaattagtggaaaataatgaccttattgttggttaagtgcggggaaaataaactattacgtttggatgaacttagcttttccttgtgaaggttgccagactagctattattaatgtactgtaatttccacaaggtttctttcttctggtgaaagattttttttttccattttctgatcaaagcactccacttgacaacattcaaaaatgagtgtgcctgtgccttctccaaaacacctttggtatgtcggtgagacctcgtcatcctctagtggttctattcaaaagttacattccacatagatgtccgcttgagctttagccagtagataccgtcctcagtgcttaccgtgatactccaagcagtttcttctggatgacttccagagcatcacagctcacgtgaactgagactactctgctttagctccattctaatggaatgaaatactctgttcatcttttctttctcactgtttctattctctttccaccatctcatatgccaaaatatcctgtagaatatttattttctattttgagccacaacagtcactattatatagattcctaatacacttttctcaatatttagaaaaagtgataatcataagtagtgtaaaatattccagtcaccgagtatgtactattaaaacattttctccttgcaccaaacagccatagcagggttttgttttgtttcattttgctttattatccgacatgtagtctcttccgaaaaaagtgtattttagatcccacaaataaacgtatcaagacatcaagaaacaggtaataatttataaaattttgaacttgcacttactttttttactgattccaaccaagaaaaaagtaatgcaaatataaatccctttaaaaattctatcatgaagacagaaatagctgctggatttaaaatctaatttataatgtagtgataagaataataatgttaaatgtcatacgactatgtagaaacagcatgtagtttcaagcaactaatgagctcttttggaaataaataattctcttttggataaataaatgttctcttttggaactaattcaatattatcttttaatacctgaagcagaggggtaccagaatattgctgcaaacatctgggggcaagacttttgtccaatattaaacatgtctgtaatataaatatattcttttaaaaattatctgtttttttataagaaggaactgtgttgtatatttatttcaaatattctatactttaaactgctgttataggaatattacaggaaatatttctgtgtggtcaaaagaaggcaaattaggtataaaatttgcttggatgtattaacttgagctttggaaagagccaggaaagacattgagattttttttgcagctttccagtctttccgcctttctccttcccctgtagctgtaagattgcctctccccactcctcacgccaattttgctgtcctgctgggaacccttttcagagagaacaagatatatagatacatgattgatagatagaaagatagatagatagatagatagatagatagatagatagatagatagatagagatagatgatagagagacagatagatgctattgtaaataacattctactgtctctttattaaataccacgttcccaattatttatgtgtaaattatctgcagtgtctattaatagtctgaatttctcactcttattgcactttattgtcttggtagactgggatcaccatcagagtacaattacctccaggacaggaagataggtcaaatttaatacaatgtgattacataagcgtgagtggatttttccttgctattgataaatttcattagctaagatatttgatatctgtttcataatgctaaaaatatgtgcaaatattctcttttatcagcacatttattgtcagccctccatatctgtgggttccacatctgtggatccaaccaactgtagtttgaaaatatgttttaaaaatggatggttgcatctgtactaaacatatatagtatagacttttttttactaacaattccctaaacaatggagtataactatttacatagtgtttacatcatattaggtattataagtaatctagagataatttaaagtatatgggaagatgtgcatagtttctatgcaaatactacatccttttatggggacttaagcatccatgggttttagcacctgtgaggggtcctgaaaccaatcccccagggatactgagggacgactacattctctattacttcctttgatgaggttactgacctccactgataaattctcatgcatttgtaatggacttaactccaatgtttttgtaaacatatagtattagtgagcaacttctatgggttttatttttgcagtaagttggattactcactagattgtgagctacttaatgtcttatacatctttatagtctctgtgttgcccacagtaggtagtcaatatttgctgaacagaagttaaacattttttaatcactatatatgatatttctttggcataaatgggtttttaatgtgttagagtttcatatgcttaaaaatgtgttcaaaagaaaactatctttatgtcaaaaagatttatacagtttgctttttaaagtctgtgtgaatgaaccaatactctgtcttatgtcacagctggacactccaattcaccgctttaagtccagcactgctaattccctgactagcttccctaggaaaggatattcttttaagtctggcgctatgctgtaaacacactcctgtttattccagctaatgagaaacaggctgtctggaaatgtgtctctgaggaaaatactgagcaaatctttagaaaataaagcactccagattgattgaaaagataacatttggtaacatggtgcaagaaaaactataatatcaagctcaaaagaaggcaaattaggtataaaatttgcttggatgtgtcaactggagctttggaaagagccaggaaagacacagaatttttgcatctgtccgatcttgcccctttctccttcccttgtagctttaggattgcatctcccactcctcacaccaactttgctgtcctgctgggaacccttttctggtcttgttatctttctttaagatcagccaggctgtctcttcctctttttcttctggtaataaggtgtctaataatttatagccttttaatctaatggctctttctgtggacagtttcaaatctcttctttagatacttgcatttgaaaagccactaacttttgaaacatagtcgttattatcaaaaagttttgtaggactgtgccttactgagcattgatttttgtacttggagaatagttttatcaaaaacataaattatttcacttattcacttagggtaaaatgcctaacagtagacaagtgacaagacttaaaaaaaaaaaaagcagtttctcatcaaattctaaatctcttgaatctctcgtcttcataattcttcaactccttgaaagtatatgaactgcttattggtcattaacttatttgtaaatgcaagtggaactcccattttaaatacatcccctattgattctaaaccatactctaaatttgtctatgttgcccattcccttccaactttagccatcgctgaaacttcaattgctttcctgatgctaccaaaagagcagtatcatcagtgccccctcactaatcatgtaatcttccttcagaaagcatttatgttttttgttattttcctataagaagagaagaaagtctgttttggacttcgtccagccaacactattaggcaatttccactaataaaaagtgtcatgagccatgatagaaaagttttactactttaagaattttttccatttcatagccaaagaatatctgaattttggagataacacataaatatagagttttaggttctacaaagaactagggtacagaaaaataacttggtcatttccccaggaaatactctgactactaataccacaacgactcctaacaccactactgtaacaatttcacatttcacagtattttccctctccatagcttcaattgcagccaacatggaatccaaagagaaccagaactttcgttgtgagaatgttttacacttattccatttacacttaacacttcatcataaaagtagaacaggtaatctcaatgatatttcattggaggctctaagaggctaaatgaacgacttgattaagtttaccaggtttatagcagaaatctactaatgtcttcatttctgacctacaaatggccaatgggtctaaatttatgggccatagacattcagggttctatagacttactttaaagagattcatatctacagatatatattttaaactaaataaatattacaataatatctttgtatttttcaatatgataaaatacaaattaacttttaaattttattggatttagagtgtatttttattatatatttcttaggcaatgattaaaaataaagttactactactatagtgtctggattcttttttaatgttaatgaaagattttcataccaaaaaatgttgggaacccctgtgctaaattatgattcaggttgctgtatttaattatgatttgggtctctgggccacaaataaagctaggagaaggaaagaacttatctatgaagaaagcaaagcttcttttggttttctatgcaccttttctgtagcttttattcctatctgtcacatcctcaccccttacatgtctctctttcctcttccatcaggaaaaacaaacaaactaaaaaacttcatgatgtttatggaagctacatgtgtttttactaacaatatttattgaatgtctattgtggatgtggtaatgtgctatacaccttatacacatcaactcattttattctgacatcaaccatataaaatggatattattcgtcatatgttgcagatgaagaaactgaggttcagaaatatttacccttcaaagtcacaaaactgatgaactgcaaactcatgactcaaaatcatggctgacaaatcccaatgcctacattctttcaaaggtaaatatttgaatttttacatttttaaggctcaggtatgaagttaagtaacttaggtcattctagaatatagagtttcattttgctattttaaagtagcagctgttctttgaacatagaggttgtgtcttctttgttcacctgtcaatcttcagcacatagcaaaatgtctggcatataccaaatgcccagtgaaggctttttaaatcctttctcattctttccactttctacattcagttaatcattctctctcaaaaatgtctctcaaattttacttctctttatttctattgccactgtatttgtataagttcttgttgtgaacagaatcatgtccaccagaattcatatgttgaagccttaacacccaacatgactatattttgagatagggcccttaaagagacaattaacgtgtaaataattgagtgtatggtagttaataaagagccagtagaatattagttacaatagcatgcaccacatatacatcttgctctctttgggtttacacacaattacctactgtcctatccctctaactgcaacagtaagtattgaaatttgggtcataagggtggggccctaatccaatatgacagatgtccttataagaagaggaaaagacaacagcaatgcacgcacagagaaaaggccgtctgaggacacagcgagaagatggccatctgcaatcctaggagaggggtcccagaataaaccacctttaaatcgatttcaaacctattatggaattattcatgctaaatataccatagtgtttatatttctaggccaacatgataagcatattaaaaatgactccaaagcagatcacaagtagaatctaaattattgactggtttgctttttagaaaattatgtagcaattccctcacttaggaaaatttaattttaggctactttgcatggtttccaactgtaactttccatgggaaaaaaatacaggaaaatgggcatgatatacttaacatcgttgaaaatgcataatgactccacctttctgaatattggtcaaatgttacattcctaagaacttcatttgttgaatcatcaaactttgttagtgaagacctaggtatggaggttaaaagctgtttttacaattattaggctacaaatagttattacataaaatttgtagatgcaatagaaatttgcttgccaaatatttaactaatttgactatagtgtgaaatcttcttaaagtggatgatctgatgattctttgctcactgaggacagcagcgtaggagtaaaattttagttatttttaagaacccatttcttaaaatgtatggcatgaattgtactcattatttccagcttcaagtattccacgagaattactctgtttctttgtttgtggtataatcatgggaagttcacctaagggcagagtggtaagtgtagaaaatcctggtttattgcaacacatggggactatatttggccttcgaaaggattacttgctctaaagttttagcatgcagcatctagtattcaggataaaacatcatgttttttcttaaaatcctggtcaaagttctggtcaaatagcatactagcttttttttttttttttttttttttttttgcccaggcaaaactgcattgtcattgtgtccgtgatatccagttaataccttgttaatagcctataccctctagtaggctttaaaaaaaaggtctttgtagggtggggacacagatgaacataaatcataattaattaacaggccacaaggattgccatgaaaataatagcttcctgggtccttcaaatctaatctaccatcaaactttcagagtcaaagcaatctctttgacagccacttgagttaatttgaaattagataagtggagaaagcagagaagctttccttttattgaataaaaattaacttctaaaccatggaaaaataacctttcctgtgattttgtgattggtgatcacactggaaaattgttcaaaagtattaaaaatattgattcaataatggataatcttttacagcttttatttttagtgtcccttgaagaacccaattctttaattactcttacagaaggaacacaacttcataatccttaatttaggttcaatagagcaacaacaatcgttggatcaagacaagtctaggtttaaattctgtatttttaacttgtagtaaccgttctagatgccaagtttcccttcataaaactagggtagtacaggctcactatcccttattcacaattctgaaacccctaaaccactagaaaccatttttttcttactttgcagaaaaacctgatgtgacccgaatccattatgtgaaaacctgactagcactgatgtggggctacttacagcctttacttattctatcctatatagatatgcatacatttcactgaggaaggattaatgttgtttaccgaagaaagacaccccaggcctaaaacccaaagatttcggaatcctgacacatatttagccggaaggatttcatataagggattatggacctgtaataccaatgatgaggattcatatgcagagtaaaaaagcaatcaatattaattagtaatgcttgacccaaagtagatttttttcaacaaacacattgtttcctgttccttcacagacaagtgttctgtgcaaaattatattcgtgttaaatgatccatttattgccttacctccccaataaatgtgtgatgacatcttttaaaaaagaataattttggttcagatctataagatgtgacaaaccgcaattgtgatgtttggaatgattccaacacagtattacagttttttttaaaggccatgccatggacagtttcttattgtcttacctcactgggcacgcccagtgctggccgtgtattgtgacttgcacagacaggaaggccactaggatcctgaaatgctagaaataactcaaaaataaaaaataaacaccagcagtaaaaagttagacaatggagaaaatgatttagaaggaaagcctaaatattttaactcagtgtttgactatgaaaatgggtaaagagaatggcatattcagaaagtatctaaaccaaagtcagtgagagaactacttaacatgacactagagtgaataaccttaaaggaatgttattctcatttatcaattcaaggtgatgataggactagttcatcatttcgatttcaagatttactgttttccaagtgtatcttggctattgcctcgttctcatgagtctctaaataccgttcactaagcccaaattaattgtctgaaggcacatagtgaagcagtaatactggttagcaatgtttgtttcatcaatgaagctactgctctttccataagtatgactaataggttaaaaatatgcaaagggaaacttgggaagtctgagggattttccaactccaacaaccaattctctgattctctggacaccagctgggtgtataacaactcagttcaattctgacacccagagttagctcagatcccacagcttaaaggcttggtcccacaggactacccccacttcaggtgtctgtcataaatcctgggcctccggtacttctgaccaactggctataaattcaggattctcctgatcccttcctaaggtttggtaatttgctcgaatgcctcacagaactcaagaagatgcttctcttatgtttactggtttattataaaggacacaaatgaacgtccatataaaaagatacataacgtgaggttcagaagggtttccaagcagaggcgcttccatctccatcctccatgggtggacaagttcactaattctaaagctcattgattcctgttattcaagagtttttatagagctcagtctccagcccttcttccctccctaaaagtcaagggtggggctgaaagtttccaccctctaatcacttggtctttctggtaaccagccccaacctgaggctatgtagggatcccatccaaagtcaactaattagcatacattctgctgtggaaaggagctctttatgcataaaagaagactctctgatcagggaaatttcaagagttttaggagctctgtgctaggcactgggacaaagaacaaatatatttcttcttttttttttcttttttttattacactttaagttttagggtacatgtgcacaacatgcaggttagttacatatgtatacatgtaccgtgttggtgtgctgcacccattaactcgtcatttaacattaggtatatctcctaatgctatccctcccccatcccccgacaaatatatttcttattacactacagtagttccccctgccccttatctgtggttttactttccatggtttcagctgcttgtggtcaaccacagtttaaaaatagtaaatggaaaattacagaaataattaactttaagttttaaattggacatctttgaatagtgtgatgaaatattacactgtccctctccagcccacccagaaccagaatcatccctttgtccagagtacccatgctctatatactgcctgtctgttagtcacttagtgactgctttgactgtcagatcaactgtcggcagtatcatcgcagtgcttgtgttaaagtaacccttttttacttaacagtggtcccaaaattcaaggctagtgagtttggatttgccaaaagaagctgtaaagtgcttcctttaagtgaaaaggtgaaagtccttgttttagtccatttttgcattgctaaaaagaaatatctgagactgggtaacttattagaaaagaggtttaattgtgtcatccttctgcacactgtacaagaaacagtactagccgggcacggtggctcacgcctgtaatcccagcactttgggaggccagtgcgggcagatcacttgaggtcaggagtttgagaccagcctggccagagatggcaaaaactcatcactgctaaaaatacaaaaattagctgggcatggtggcatacgcctgtaatctcagctactccagaggctgaggcatgagaatcgcttgaacccaggaagtggaggttgcagtgagccgagatcgcaccattgcactccagcctgggcaacagaacgagactccatctcaaaaaagaaatgtagtaccagcttctgaaattgtaaaggagagagaaacttgttcatagtatatacaagattcagtattatctgaggtttcaagcatccataaagagtcttgcatgacatcccacatggacaaggggaaactactgtattttaaggaattttaaaaaactattttctgaaaacccattatatccagatcaactatagcatggagaaatcatataagtactattcgtgtttgactaattaacacttcaaaaagagaaccagaaaatcaacagagaaaaatttatactgtgaaggaatggggagggggagcatctagatttattatctctcccagtagaaagaatgcaatgttacatttcacacatgagtttttttatggaagactatttttcaatgttaaaaatatctccctcccaacatcagctaatttggaaaaaaataattcaacaacatatcagaggcctattaccaacttctaatgtagcgaaaattggcaaattattatacaccagggagataggatttcatgaccttcctattttttctttacaaaatgtcagggaaaccttactgtctcactctagctggatattaatgataattattttttggtacaaactcttttcagatataatgatgtcctctattttccttcttgcattggttttactcccacgagagtgacttccattcccttattgcacaaggccaaaaatccccacaaacagctgtcaatcttactcttttgcacagaaatttttaaacatctggcaggaaagccattcttaatcttttacaattgtagattaatatcttaaatttgtaccaagaaggcaggaacctatgtgaaaagaagttgagtgtgttagtcattctgactcatcactaaataggattattgaggacttaatcaacttaaatttatctttagaatatgccaaaaatttcctttaactacatatggccttttataggttatttttttcatggagacaaaagttgagaactcaagtccctggttatctgtatatagccaactggctgtaagtcaggaatccccactaatccctgaatctcattatttcctccatatgcaaagaaataaaaacagtcaatgcaagcacagtaggctcttggtatccgtgggttatgtattctcagatttcaaccaattatagattgaaaatatttgaaaaaaaggtaaaaaataacaatacaacaataaaaatagtacaaataaaaatacaatacagtgaacaattatttacatagtatttttattgtattagatatcataagtaatctagagatgttttaaagtatacgggaggatatgcacaggttatatgtaaaaaaaaagtacttcttttatttaaattagattcaaacaagttcctatacatgtatatttatatggttagcaaatttattcacatccatggattttggtatccaaagggaatcctggaaccaatcccctgaagataccgagggacaactgtatgtacatagcattgcattggtccagcatccaaataatgtaaacatttgctatcataggtttaaggcaaataaaacaaaaatacttttttaaaaaagtcaagtaattttaaaaagttattttatttaatttcactgttctttagagtacacaggctaatacctttgttggcattgctctgtatatcaacataagagaaagttttgaaactaagcaggcctcaggttggattctagtttgctactttccatctggataagttgggttgagttaaccagccatgtgaagtctcattttcctcatctagcaaacggacataagagcacctacctcaaggtgtagttgagaagactaatgagataatatatgtcataagcacttaataatgattgttttcactcaagtttttttactctaagtatttgtaacttctaagttttacagcatctgtagttaagatcagtagaagcaacgccactgggacacctgttgcaggaacacaagcaagtctacatcttctccaagctaaactgctgaagtgtcttgggtcccttgtttttgtcttctgctttacttttccctgactttggtttctctggatgtaatttctttctgatacaagttcgtcctcagttctacttttgtttccccctaataacctttggcaactgaacttcaagctcttttgtgttgaattttttgctgtcctctgtttattttattcattcattgtttttcctgatgcaatgtggctaaaatgcagctccagatgcaaaacagttttaggtaaattttcgttcaagattattacattaaaatttaatactcatagcatattcttgccttataatttactatgaaaaagccctccacatttaatatttgaaataaatctacatgagctaaacaaaaatcatgcatgtatactaatgagtagaatacactctaggtaatcaatgcattgatcacctattagtattcacagatgttctaatatataatgtttaaggcatacgaatctatatcaaaaacattattcttattaacagttacaaaacaatgctgctagtcattcaataatgacagtatttatcttcttcctagaaaatgtccttttaatggtgagcattttgcttagtatggctaaaataatattaataaatcatgtatttgtttcaagatatgccaaagccaagaggtttatgaaaccgcttcatcattttctgcttgatttttccctcacatattctgccaggagttattgtaaattcagtcctaattcgattaagacattcccagtcacctcttcctcatattcttatgtacactagccaaaattagtcagataagtaaagttttcctttgacgaggggattttgattcttaagccaaaaataatagatttaatgctggaaagatttaacagaaaaaataaacagaagattttttcaaagggaaatgaaaatattgaaagtaaaataaatcatagtaataaagctgcaataaatatttgattattaaaattcattgaagaggtcacatttctatatcctacaataagataacatttcttttttctgggttaagtaccatcaaggcctttgaccttaaggcaacttcctgaggcaacttacaatggagactccacaatcaacagaagctttgagggtcccaccaggcacacaagtggagtggagtgacatggctgtgggtttgatctgaatgggaatgagtttcttaggaaagcctaattcaccagttccaataatgcttgagcagtaatcttatagcttatgtgctttgtaagagaagtctttaatgcaggtaaagacaggataagtgaatacaggaacaatcaggagaaaagtatactttaatgtaccatttaggggatggagaagaaagaaaagaaaaagaaacaattatttcaaggtctcattaaccttcctccactcaatctatgtcaagtaaacatcccacaagtgattatgaagaaatagtataggtcgagtatttctaaccccaaaagcttcaaaatataaagctttttgagcaccaacatgatgccacacacaagtggaaaattccacacctgaccttatgtgatgagtcacagtcaaaacacaggcacacaacacagtttattcagcatccctaagtgaataaagaccctcccagcctttttcagctgcaatatatcttgtcttcacacacccagattccccgatgcaagcacgcctacaaagggtaatagaatggcacacgtgcagaccatacatgtcaatggcaggttctctgtaatgccccaagtagcgctaagctctatgtgcatttctcattgtgttttttgcgtattcgttctgcagtgtaaaggcactgttgaaaacaccaaaaatggccgagggcagtggctcatgcctgtaatcccagcactttgggaggccgatgcaggtggatcacgaggtcaggagatcgaggccatcctggcgaacacagtgaaagcccgtctctactaaaaatacaaaaagaattagctgggcgaggtggtgggcgcctgtagtcccagctactcgggaggctgaggcaggagaatggcatgaacccaggaggcagagcttgcagtgagccaagatcgcaccactgcactccagcctgggcgacagagcaagactccatctccaaaaaaaaaaaaagctaaaaacacttacagataccctacaggtaacactgataagaaaaacagggaacatttatgtttatctatagcacaggaagtcaacctattggagaaactggaaagtaatgtaggtatgaaacatcttacggaagagtatggtgttagaatgaccaccctatattgacctgaagaaacagaaggatagactgttgaaattctatgctgaaagcaatgccagaaaaatagaaaaatactgcataaagctgaaagtgaagatcctgattgtgcattgaaagaggagatccatcagcatcacagtaatacatgccacttaatggtatgctgatgatgaaacaagcaaagatctatacattggatggaactgtgattcaacagtttcattgcagaaatttaagtgaagacacagcatcaaatttttaaagatttttggtaataaagcactgctgataatgaagcagtggagaaattccttgaagagtttgccggggtcactgctgatgaaaatctgatgccagaagaagtctgtaatactgatgaaacatcactaatttggtgttacagctgatgagacagcctttacaggaattaaggataccaaggacagtaaaactgggatgtgctaatgcggcaggcatgcataaccataaacttgttatgataggcaaaagcttgcactctcactgttttcaagaaataaattgcttactagtttattatgctaacaaaaaggaatggatccccagagctatctttactgattgttttcacaaatgctttgtactagtggctcatgctcaatgtagggaagcagaactggatgacaactgcaaggttgtgctattctttcacaactattcttctcatcttccagctgaaagtctcataaaaataatattgatgccatgaaatttcccccaaatttgacttcatgaattcagccatgcaacctggtatccttatatcaatgaagagtaaatatacaagtactttcttgaacagcaggctaacagcagtgaacaaaggcatggatgcagaaggttttcaaaaggtgtttagcatgaaggatgcaatatatgctgttaccaatgcttagaactcagtgactaaagacacttattccggtttattcctggtacagcctcgggcctgagactatgttcactaatgatgaacaaggtcatggctttgaaggattccatttgtcaagtgcacaaaaaaatgatgtctgacctcattacatatgcaaaaaatataccttcagagttctgtaagctggaagaagcagatgtgtcagtttataaaatcaaagggagacttctaagacaaaaaccattgttagtgaagcagacgactttgaagaaaacattttaaaaagtcatccagcagaatgtctcttcatctctagaggactcacccacttcctggtttctcgactgcttctgatatttcttctcacctaagaaagtaaaacacagtgtacagtgcattttaatggaacagaacatcctaggtggagactgagagcctgctggtgtttattgttgctgttgtttaacagctgatacaggtatctggtgcagctgctatgctgctcagttaccctgaacacgttattgttttactgtatttatgacatgtccattttttttttttactgttaagtacctatgtgtgagtaagtgtgagaaaatgattgcttgttggtagcatataaattcagagtcaggaataatggtgatgccaaacaaccacagattgtccacatgggtgacagagatagggacacctttactttcacctttgtgtactttcaatgtacacagactttgttttatgcacacaattatttaaaatattgcatgaaattaccttcaggttatgcatataaggtatatataaaacatgaatacattttgtgtttagacttgggccccatccccaagatatctcattgtgagtatatgtgtatgcaaatattccaaaatctgaaaagttctaaactatgaaatactttcgttcttaagcattttggataagagatgctcaatttcatttatgagctaactgagacagatttaaaatggtttactaaaagttttacagtgaattaataggagaaatagagcgactggaacaagttctcttttagggtcccagaaaaatctggaaagattattttgtttaaaagtatgagaacattacatgagaagtagattatttggtcatacaagaaatcactagtaagataccacaattaacataacagaaggaaaacggatgatttatactcattaactaatttatggataagtacaggtgttttaaggagaaaattatttatacaacatggttcacttgtgatatactgcaaataactaagtttctttcctcagagcagaagagaaaggaacattttaagtggaaataggtctcaggtgttaagaaggaagaaaatgattcttcagtatatacttcatgtctaaaggcatagttgaaaacttccaaacaaaaatttaattgaccataattttccacacatagataaaaatctaatctaataaatttagcagctatgcaaatataggtatgtatatgaacttgtctgatcttatttaagtaaaggaagcacttttttgtaaatgacaatcttttggggtatgtaaaatttattatattatcttttcttccccaagatgttacacaagtatcactagttcctgagcactgagaagggtttgaagtcagagttagcacaaaagctgcatatttgtgttttggttaatgttgcttaaatgccatgttcattttctggccttcagactcttgtccactatcataccaaagcacttgagactcttttaataagaaacaaatcatctcattctttgcacagagatagagtttaaatgttaacatctcagggaaaaacaacaaatagtgaattaaatttattctgagctgtaacatctgatattggaattttctaataacaagtgttttctatgctcagcccatgaaatattttggaggtcaggggccctaagattcacatacagttgggtttaactcagagcacacattcttagatgtgataaaaatttagagatcaatgcaatttagagagtaatgtctagcagcacaaaaccatcccaaagttcagagtttaggctaaaatgtgctagaagatatgatttcaacctgaagtctagataaggattccttctcctttctcattgttcaagagatatgaggttatgcactaccctaatttgattcacaagtcatgggatccatgaagaacctagaattgagagacagggagaacactctccttctccccactaccatcatgttagaagatttgacttagacagacttaatggctggaaacaggaatcagagaaggggtcattgtccttcttactgataaattagttaggaattaacatagtcagcatggagcctatttcctaattttgaggtaaaataaccacagtgcaaatataaaccagattttatacagctgagactccaacatgcatgttaaagggaaaatgagataatgaacagagttaatgtattcacttcaatgtgttcctctcatagataggaacacagagcttattcttaagagaccagatgaagaagaagatattaacattcttctttacccaaaaagtgagggaaaatattgttatgaataagattaggaaaaaattgcttaaagttaaattttctttcctgcaggccttctcatagactatcatacgctaaattactttatgaatcttcatgaggagggttatattaaggatcatgttcaaacatatttggccatgaaactctttattaatatctctcaggagtagtgaaccaagagattcagttcaggaaacactgattacaaatgagaactaacctcagtgatgaaaaggatgtagaatgtgtgagctatcaattcttctcactctgcaagttttgccttcctcaaaaagcaaagcactgcaaggaggctattgcaacatcaatgcaagagatgagggtgtatcatgatcttatcaagtccattgaactgggaaactctagggcaacattctcattgtatttcaaatgaaagttgtaccctgaagttgtggaacatggaggacctgagggcaatagttgtaaaggtggtgagaagttgctggatgtaaggtgtatgttgaaagctaagctaatagaatttgttttagcttggattttggatgtgagccaaagaggaataaaggatgatctatatgttttggcagaagcataaagtgaatggtcatccatgagagaagcgagttttggcttggagggaaatagaattccattttggactttataagtgttagattcatacctaagtgtcaagtgtccagtttgacatgtctctgatctgagggcatatggaagggttggagtggtaaatttgtgaattatcagatagaagatagtatttaaagttgtggaaataaatgttatcatctagggcatggagtatttaaatgaagggtgagtcaagaggacacttaaacacataaaagttagggcatgagaagaattaataaaataaatatatatgcaatggaccaatgtagtaaggagataaatttaaaaggtatggtatcctagaaaccaagcagaaaaatatttcaagaataaataaggaatctagtatgtcaaccaatgctgaaagttaaatggaaattattgatcacattaacaatcaaacgatgagaaagaaagcacagtatcaagataattaggttgaagaatatagacagcaagtaaagagaaatctttggaaaaattttgccaggaagggaggcaaagattaaggaaacaatggtgaacctaacgatttatttatttttttaaattaaaaaggattaaagcatgcttatatgctgaagggaattatccattaaaaagggaggaaataatattgcagaataaagcaaagcccctttttgagtttagaaggtatggggttccgtccacaagtcagagatttgatcttaacctgaagaagcagtggcagatagtggttaaaaacaacagactccaatgctagactacagtcccagtttcaaacgggataccactatacacctatgccttaaatccaaaattcagataacactgaatgctggtgaggatgtggagaaacaggcactctattcattgggaatgcaaaataatccagccactttggaagacagttttgcagtttcttacaaaactaacatagccttattacatgagccagcaattgtgctccttggtatttgtccaaataaataaaaaacatatgttcacacaaaaacctgcatacaaatgtttatagcagctttattcataatacatgaatggataaataaactgtggtacatctatatgacagaatattgtatcctgccaattatttctttccttagatgtttccccaggaattagaatatgtagaacatgtataacactggaacatcggatatatatataacaaaacagttgctcctcattccttccagatgcagtgcagtctgtataaacgaaaactaaattagacatgaggcactcccttttctgttggaagaaaatggctgatgatggaccattttaaatgggttacccttattggtacactaatgtcactaaaataataataccaataaatctggagacttcaacatttggccaagatggagtaagaaagactgaatttgctctcctgagtaaaacaacacgtaaatgaatacaattaataaaaacatgctatttacagtactggacatcagagaaagaacactgatctctgagaggcaaaaaaacaaaaaacaaacaaacaaaaaaaacaaacaaacaaggcaaactaagcaattaactcaggttactgcataatttagttttcagctgtagtgcaatgcagataaacccagacaaagtgctgtggagtccctgagttgaggagacagagctaagagtccatagaaaccaaggcagctggagtttccaagccaaagtaatagaagaaaactaagcgaatagaggactgtagaaacacatggaaatgtctttatgtattcagcagagtattgatcaaaaaatgtgtgcatgtgaggaaacttcctaaggctggggaaagagtcataaacaagaattaaagagcaggaatagtgtctgcagaactaaccaaattgaaaatcctcaaattaatgggacattgggtacagtactcaaataggccttgcctctggagagttctggactaatcacagccctggttctacctaaaaaactgaaaacataaaaggatcaaactgtttttaagtaacataactatatcccccaacaaagcacaaatatatgtataggattataaaaacataaagttctccaaagagaaaaccacaatgtttggcacccaattaaaaacaatcaggcttgtaaaaaagtaggaaaatgtgaaatatgatgagaagaagaatcaatcaaaaatgatccagaaatggcacagatgtgatagtgagcacaaggatattaaaaacagttatgctacttacattctatgttaaaaaaagaaaaaaaagaaatttaagtagagataaatagaacaaattataaaaactacatattctgagatgaaaacttttactggataggattaagaatagattaaaattataatcccagaactttgggaggtcaaggcaggcggatcaggaggtcaagagattgagaccatcctggtcaacatggtgaaacctgtttctactaaaaatacaaaaattagctgggcgtggtggcacgtgcctgtaatcccagccacttgggaggctgaggtaggagaatcacttgaacccgggaggtggaggttgcagtgagccaagatggcgccattgcactccagcctgggcaacaagaatgaaactctgtctcaaacaaaaaaaaaaaaaaggaaagaaaaagaaaagaatagattaaatttttcagaggaaaaggttagtaaactgaaagacatagcaataaaaaatatcaagaataaaacttacagaataagaatttttgaaaatgcacacagtggctgggcacagtagctcatgcctataatcccagcattttgggaggccaaggcgagcagataacttgaggtcaggagtttgagaccagcctggccaacatggcgaaaccccatctctactaaaaagtacaaaaaaaaattaggtgtggtggtgagtgcctgtaatctgtaatcccagctacttgggaggctgaggcaggagaattgcttgaacctgggaggcagaggttgcagtgagctgagatcgtgccattgcactccagcctgggtgacagaacaagacaccatctccaaaaaaaaaaaaaaatgaaaatgcacacagcatagtaacctgtagcagtggcacagtttcaagtggtctaaaatacattgtgactggagtgcctgaggaagagaaaggagtgaggaggaaatatatctgaagaattaatgtttgaaaatttttaaaagtttgataaaaatataaagtcaaatatctgagaatatcaataatcttcaagtaaaacaacaataacaaaattaaccaaagaagatcataataaaattgtttataacagtgataaggaaaaaaattaaaagtagaagggaaaaagagatgtcaaattcagagaatcaaagataagattgacaacatattttgcataggaaccaatgcaaccaagaggtcagtggagcaatatccttaaagcagcaaaagaaaatctgtcaacctagaattctgtatacctagcaacagtatctttaaaaacctaagatgaaataaagattttttagatatgcaaaagctgaaagaattaatgatcagcatacccacattttaagaaattttgaaagtcaagcaaaaagatgatactgaattaaaacatggatttttttcactcacaggaatgaagagaagatgctaattacatggatcaatatgtaggtttttattatttagatctttcaaaggtaatgggtatccaaataaaaataataacaatctattctagatgttctaaaatacatgaagtcaaaatttgtgacaaatagcacaaaagctggaagaggaaatatgagtgtaacatttttaagttaaatatgatgtgaaataatagctcatgaaggtagactataatagttataatggctgtattttaaataccccaaacaacacctgaaataaccaaacaaaggagataaaatggcattataaaaagtacttaatccaaaagaaggcaggaaaaatgggaaaaaggaaataaagaacacatagaaaaatagaaaataaatagcaagatgatagatttaaacctaaccatattaataatcatattaaatgtaaatgttctaaataccataaatcaaagtcagagtttgtcaggttgaataaaaagctagacctattatccgtaatatccccttactatacttacataatattatatgtaaagtctataattatgtcattgctctcattcctgatatttgtactttcatatcgtttccctatatttttcttgattcaatctgcaagtcctatagctgcaaggaactgaatacttcaaacagtaattggtattcataagtactgctggtgagaatgtaaatggtacaacatatttgtaaaccagtttgacaataaaacagctatcaaatgattcagtcattccactcccaagtattttctcaagataaaggaaaatatatgctcctactaagaactgtacgtgaatagtcatagcaactttattgtaataataaaaaagtcgatacaatccaagtgtccatcggcatctccatggttaaacccattgttatatccccacataaaagaacacttcttagcaatacagaagaatggactatcaatatacattataatataaattagtctcaaaatcattatgctaagtgtaggaactcaggccacataaaaaaattattttattaatggattaatataaaattctaggaaatgcaaggtatagtgaccaaatacagatcagaagttttctagagacagggaaggctgtggtagaatgaagtgggcaggaggtaggaattaagaagcgggggcaaggaagcgttggggattgacagatatgttctttcatttttttttagatggagtctcactctgtcaccaggctggagtgcagtggcgagatctcggctcactgcaacctctgactccctggttcaagtgattctcctgcctcagcctttctagtagctgggactacaggtgcgcgccaccatgcccacctaatttttgtatttttagtagagacaggatttaaccatgttgaccaggatggtctcaatctcttgacctccagtgatcccctcgcttcggcctcccaaagtgttgggattacaggcatgtggcaccatgcctggtggacagatatgttctttttctgattctggtgatggtttcatgaaatatacacatgtcaaaatgtttcaatttgtatacttaaatatatgcagccaactgtattacaactttgagtttataaaactgtttataaacaaataaagcctttttgtttcaatccctgaactgtctgttttcctgtttcgggaatagattcttgaactctgcaaagacataatacaagtacaataacttgacctatatcaaaattagccttgaccttgttcattggtgaaaagctactatttgcttttggcctttggcttagccttgggaactcataagctgaatgcctgtcttatttatttacctgaacttatactgcatgttgaatgattgtaaaatccttgcaatcttttaggttgccatcaaattgaatctcaggaacaagaacaagatgtgtcatgaagatttattgttaatatctgactactcactttcaaatttaggtacacattctagatagatgcaccttgaaatgtgtttcatgtattggaattttatcagtcagttgaagaatatataaatatcatcttaagggtaaaattgataataattaatgataattatgaaagctattcattttatgtacaaatcaattcttgagaactttcaggtagtcaaataaatacagtggcagttaattggtatataatgaaaagtaacatagatgaaaattcagttcttgttatcatgaaattcaatttaatcgtactttggaacattgctatattcaagatctattggcaatttcttccaaaatgtgtgtgaaacagtaaattcaagaagatagtaatctgagtgagggcaataactttaaatttccttccgaaaatacttcaaacgcatgtacatcaacaaggcagaaagcttcaatgtgtgggattgctacaaagaaattgcgtcattatcatcaacccaacaatttttatctctcagaattagaagagaaacaagtttacatcagtctctacttttgcatagaggaaaggaatatagcatttttataaaaacatcaagaaatgtactctgcttgaagattcatgacctttggaaaattactggtttacgttctgcaaaaccacaggccaataatgtagatttgttttaacgatgaatttaatgttatgccaaaaatttcttcatttcttgtttcatatctcacaattttatgaattgccatttgatacgtttctcaacattctctcagtcaatattccaattagcagtaatagattttaaataacattttcccctggtacacatctcccctgagaaaaattatagacatctataacataagattctgtctccaactatcatgaagaagtagataatagcatagaggcaaatattatttgacatatgactaatacttacttttgtccctgagctacatctaactcaaagtacaactgatcttttcttgcatgggggaccttctgcgagcctgccacatgtttagataaaaattttatcttggttgcctccctcaccacatcaagttagacagaagcacacctgcaatagagtatttctagagttcatgaggatctggggaaggaagagttgctattgcttcaaaggttggagcattaagtttcaaagttcctgaaataggaagccagaattccaggaaaggttctctctgacaattcttcaaaatactcttctctcccaccccttctggcttggggtatggtaggcacatgtgtgctcacacacatactaacagtcgaaagaaatatgcctggcagatgtccttgaccattttggggcccttgattcagtgtgcctaaactgaatgaatgtatcctgactacatgaggtctgctatgtgtcagatgtgggtggccagatggttacagttcttctgtttataatgtcaactgctcactcttcaaaaagaccactgtaatagcctacgggtaagcacagctatgcttattagccttctgcagtagggaaagcatcacctatacagtctagtttgtttctcaatagggagattagagatgagttaacaataggatttggagattaaagatcaagtagtttaaggaggactttccatgtaaggatctgattgagacagggcaaattcatcaatcatatagttgtttagaattggtggacataatgaggtgatcttgaagtatgtcttgataggtaaacagctgcttgatagtaagctgttagctcagatgagcaaactattgtgagaataggaccatttatagttctgtagttcaaataagtcagagaataatttatatagttaaaataaactgactttcaagaattttctgaagcaaactgtaaaactatttatataatatttcctacaatacattgtaaagttatgttgacacagttggcctaagtcctcagtcctgacagttcaaccaaatggatattggtggcttcagttctcatgaccaattcatcgtgatggaagaaaattggatatgtgttcatggtttgtgtaggggtgctttcttttttttttttttttagatggagtttcactcgttgttgcccaggctggagtgcaatgctacgatcttggctcactgcaacctccaccgcctgggttcaagcaattttcctgtctcagccttccaagtagctgggattataggcgcctgccaccatgcctggctaatttttgtatttttagtagagacgggatttcaccatattggccacactggtctcgaactcctgaccttaggtgatccacccacctcggcctcccaaagtgctgagattacagctgtgagccaccacacccaacctatcttggggtgctttctaatcaaaggtgggcatctattatctctactttccatttgttgtcacttctctccactacctccacccctttgccaagcaggcaaactttcttagtcatttcttagtggagaacactttatgttattgctaattctttcactctctttcattgctttcttactcagtgagatacagcagaatacaatggttcatacgtgggctcaagtgacagatttccccactgtgtgttctgtgtagccttgggcaaagttacttagatactccacgcttcactttccgcaaaatcatgatggtggagggttgatatgagaatcaaataagttaacgtaggtaaagatctcagaacagagcctggcacgtagtgttgacttttatcacaatgctgattatttcaaagcattgctgtgatgcttaattaaatgaaagaaaatgtataaagcaactagaacagtggaaataataaaaagtgttgactattacattatgtgtagctaattaatgtgtattagctctttttgattgtatgtaatgctatccagaaatcagtgcagaagggcaggggaggcttttaaattataaggggcaagtattcttttattttaaaattacttaggataacatacaggaatatacttggcacgtaatatatgccaatacgatgttttcatgttatggaagaaaggatttagaatcagataaccataagtctgaatttctgtattttgagaacttacacatcaaaaagttaatatctcagcctcatgaacttcctatagatgggcatagtaacatcaaattcatagacttgttgccagaattcaatgaaataatgcatagaattgtacagagcataaggttgtagaaaaatactatttcctttttgcctcctcttccttttacctcaatagtcttcatttaaattttctgtaaagtcaaaaagtcaaattagattatctttcagctctaaaattttctcattctatacttacacttagaacgatttcttctttctcttaactttcagagaagccctttaaatctgtgttaccttgagccatttagcactgaaatatatgtggcctgggttcattctctagtaatgagaatctcatatctttcccaaaggcaggcactatattgcgggtttctcatgtatagtttaccatgccaagcaatgctgagcatgcacttgtcaataagtacccattggcttgttcagtattataaatccatacacagtgaatcagcatctactgaaaggtacaaatactttgaagtgtcattagtgctatataagtgaaagattcatttcattgtgttctagacacttgaacactttccttgggtcattgaacatatttaatgtattcacttaaaagcacagcaagagtacttcttttcaaggtcttagtgatagattttaatgaagagtataatgaaggagtctatggggctgagcctgcagcaggagataatagaatgcagcttaatacattacagcatagtctccaaggcttcaaactcccagcttaaatgatgttatataattttattctactcaagcttgggtagaaatttctcatttcaaaagtgactgaggttggtgtttttgataaatggtatcttagctctcatttcccaacatcctctcttcctaagctaaaaataaaaatgaaatacaagagataaataacgaatcttactgatatatagaatgatgctttcattgtttcagaccaggggagtggaggagtccaagaggctaggggtaatggtaggttccagatatatttcctttaatcttgtaccaatagttccatttttttctcattttctcaatactttatttctaatgctgaatctttttcattacgcttgatatctgaatgtggtcataaatcttactacatagcacctaaaaattcctgtcaaagtgattattattttaaaataataaaatgtagccaaagaaaatttttattatttactaataaaattattgcaaaacatagattgggtgtaaagttatatttttctaaaaatagtttttgatatcacataatcatgaatattatcttaaatttgacatcatgaagaaatataaaatctgagcagaccaataatgagtaacaacatgaaatcagtaataaaaatccccaatcaaagaagagttcaggaccctatggcatcacttttgaattttactaaacatttaaagaagaactaataccaatctactcaaacaattccccaaaattaatgacttgggaatacttccaagtttcttcaatgaggccagcattactctaataccaaaaccatacaaggcccaaacaaaaaaagaaaactatagaccagtatccctaatgaatatagatgccagatctgcaacaagatgccaggcaactgaattcaacagcacattaaaatgatcattcattgtgatggggtaggattcatcccatggatgcaaggatggttcaacatacacaaatcaataaatataatatgtcacattaatggaacgaaggggaaaaaccatatgatcattttaatagatgcagaaaaagcatttgacaaaattcaacatcccttcctgataagaactctcaacaaattaggtatagaagataagtggtcaacaggtatatgaaaaaatgctcaacatctcaaaccattagataaatgcaaatcaaaaccacaatgaaatatcacttcaccccagttagaatggtatattagcccattctgccataaagatactacccaatactgggtaatttataaacgaaagaggtttaattgactcgcagttttgcatggctgtggaagcctcaggaaacttacaatcatggcagaaggggaagcaggcatatcttacatggggcaggcaagaggaagtgtgtgtgagcgcaggaaaaactaccgtttataaaaccatcagatcttgttagaattcactcactatcatgagaacaacagcatgggggaaactgcctccataatccaatcacttccctccttcaacacatggggattacatgtccctttctggacatctaggaattacaattagagatgagatttgggtgggaacacagagccaaaccatatcaaatggctactaccaaaaatacaaaaaataacaaataatggcatagatatggagaaaggggaacacttaaacattgttggtgggaatgtaaattaaatattagccattatggagtctgattatggatgtccctcaaaaaactaaaaacagaactaccataaaattctgcaattctactactggacccaaaatgatccaaaaatcattttgtcaaagagatatctgtactctcatgtttattgcagcagtagtcacaatagccaagatatggaaccaacctaggtgttcaacaatacctaggttgatgaatacgtaaagaaaatgtggtagatacacaattgaacatcatttagccattaaaaattgaatgaaatcctgtcccatgtggtgaaacggataaacctgaagagcaatatgttaagtgaaataagccagacacagaaagacaaataccacatgacctcattcatatgtggaatctaaaagagttgatctcatagaaatagagagtagaaagatagttaacagggcatggaaagggtatgggtagaaagagcataggaatttatttatttattttttacaatatagttcaacagcccagaaatatcagttagacgctttcttcttcaggtaacagaaacataaattactgtggcttaaagaatagtttatttttccttatatactaagaattctatctgtggtggctgcaggagcaggttccatatctcattgaagtcgggatgatgtcttggtgatttcttgggccatttcctcatagttaaaaagatgagctgggcgcagtggctcatgcctgtaatcccagactaacatggagaaaccccatctctactaaaaatacaaaaattagccaggtgtggtggcacatgcctgtaatcccagctactcgggaggctgaggcaggagaatcgcttgaacctgagaggcagaggttacggtgagctggagattgcgccattgccctccagcctgggcaacaagagtgaaactccgtctcaaaaaaacaaaacaaacaaacaaacaaaaaagcgctgctgcaactccaagtttcatatatgcatttaaataaagaagaaggaaaggaggtatagaccattttttaaatcaaaaaaagcaaaagctttctgccagacctcagaaagtgaaaacaacaacaaacccaaacaaactaacaaacaaaaagcaaaagctttcacagaaatttcctattatatttaactggccagagttgtgtcatgtgaaactcatagatgtgagagaatctagggaagtgaacatttaaaaacttcagttttgatatcagaggtagaaaagggaaaaaagacttagaaataggcattgaataagcccaacccatagggccatccacatcagttgtaaaggtagggaacacagatatatgtataggtccagatatgggtttttcaggtgatcccacaaaagacaaatagaacaaaaatattaaggaactagtcaagaaagtgcttgaattgataattcatagaagttaagggaatcccagaagaggattcatgtatagggaaacaataaagcatctagattttttaaatatgtggaagaacaaagctgacaaaaaaagcaatggagaaaggactctctattcagtaagtggtgctgggacaactggctagccaaatgcagaagactgaaactggacccctaccttactccgtatacaaaaattaagttgagatggattaaagattgaaatgtaaaacctgaaactgtaaaaaccctggaaaacaacctaagcaatatcattctagacatgggaacaggcaaaaatgtcatgacaaagatgccaaaaaccaattgcaacaaaacaaaaattgataaatggaatatacataaactaaagagcttctgcacagcaaaagaagccatcaacagagtaaacagacaacctacaaaataggagaaaatttttgcaaactatgcatctgagaaaggtctaatatctaacatctataacaaacttaaacaaatttataagaaaaaatgaccctaccaaaaattgggcaaaggacatgaacagacacttttcatacatacatgtggccacatacatgtggccaagaagtatatgaagaaaagctcaacatcactgtccattagagaaatgcaaatcaaaacgacagtgagatattatctcacacctgtcagaatggctattgctaaaaagtcaaaaaataacaggtactgtcaaggttgtagggaaaaaggaatgtttatacactgttggtagaagtgtgaattagttcagctatcatggaaaacagtgaggtgatttctcaaagacctgaaaacagaattaccattcaacccagcaatcccattactgggtatatacccaatgtaatataaattactctatcataaagatacatgcacgcatatgttcactgcagcactattcacaatagcaaataaatgaaatcaacctaaatgcccatcaatggtagactggataaaagaaatgtggtacatatacaacatggaatactatgcagccataaaaacgaacaagatcatgtcctttgcaggaacacagatggagctgaaggccatcttctttagcaaactagtgcaggaacagaaaaccaaataccacatgttctcacttataagtgggagctaaaagatgagaacacatggacacatagaggccaacaagagacactggggcctatcaaagtgtgaagggtgggatgagggagacgataaggaaatataactaataggtattagtcttaatacctgggcaatgaaataatctgtacaacaaacccccatgacacaagtttacctatgtaacaaatctgcacatgtacccctaaacttcaaagttaaaaaaccatggaagaacagtagttgtgagatttactaaatgagagaggtagatgggatagtggtgtggtcaggaagtaagagtttgaatttgcgatctcaggtgttggagcttactatccaaattagtgatcgagcagtagaatttaatcaacatggaaagcaggaggaagccattgtatgttttgggggaaaagaaagtaacatgaaagcttttctgtgagtaccctaatatgatagcaggttgcaaaaatgttttggaagtaacaaagaatagaaccaattatggaaacccaagttatggtttctgcttttatactttcttccaggagaagtaactattgtccaataagcatcatttgtgctttataatttatgtgcttttttcatatcacaaagtctacctttaagccctgccagttagatgccagtcacattgatcccacattggatcatggaatggatcacggttgatccttttcaagaacacctatcctcgagctgtgttgtcaataagtctggtgctcagtagtttagctctaagacatgtattggtgaataagattgagcagatgtggaaggccagggtcttactttgttttaaattaagggatcttctgattaaggaatcacagcttgttttcacaaatatagttttgaaaggggattccatatgatgacacagttcccagaccatttcttgtaaatctcaaatattgtcagtaactggcatctagtataaaaccagcagtgctttgtaactatagaaggatgagtggaaacttgtctgaggcagaaaagaaaacgaaattgacttgcatttgcaatctttttgggtaaattcattcagttggttagagaaagatcctaatttgctgagattgtgaaatcaccacttactgttagttttaacagggagacaaattttcagttcccttaatcaacatgtcaagtctgtatatttaagatatatttttaaattatactttttattattttttcataaaagttattttattagagaaaaacaaaacaaccacagcaaacaaccttagttcagaatctgttctcagtgacaaggtttcattagctcagttaccttctgtttagtggagttaaactaactgtttccggggcatgcctttccccagattttataaagttaatgaatgtaagatgatgtaaaggcaagctgctcaactggggaagctcaagttttaaataaaatcattttaaaggctatttttattagctaaaagggaaagacattttcacaggcagatctaatttcctttaatctctcctgttcagtctcttctcatgagtttttctagaattactgattgtcagttcaggtccgttttccttacactctcttccctagtctctactttaatttttccatctaaataattggatcttaaactacaataaatccattttaaccaaacttatttttctttgtaaagctatcaacagtgttgtcaataatagttgtaactttagaagtagcactttttaggtaataaactaggaaaaaataataaaacaacttctaagtataaaaactgggcttattttagctactgctgtttagtagattgaatcattatcaaaaaaatcttactaattctctcgcctcagaactttgctgtgatccctgtcaatcctatacagtaagccccagaatctcatctccagaattcttttcctattcaatttacttttattattttggcctctttcctctgcacccactgaaccccaaccaagtaaattttagagaaaaagatgatgatttctttcaactttttttctgtttttatatcttttcagtcatccttgtagcttctgcaacttattttctctgtttaacgcatcagagaaattttcatcaaaaataaaacctgtcttctataaagcatccctaattaaatggaagtaagacatagtttaaaatatcaaaaagatacatacagcatatgcctgtggttccaaagcaacagaatgaaaagtggggagttccacccatctatttggaaatttttactagtttgtttcattttgtttttgctgagttgattgatttggcaatttattttatggtctgggcaaggctctgttttcacattgccaaccaactggtcgatccattaaagaatcactctgatgaatttgttcatgtcatgaaaacaaaataatttgttcatagaactttttctttttaagtcaaaatgttggagatcatatttatatcaaaacatgtgcaatgtctgtttttgctgcaacaaaagcatttttaaacaatgctgtagctctcacagcatttctttagatatataattgtttgcttgtagtgtattcatttcttctaactttgtgtttacaaagagcttaacacattgtagaagcttaataaaaatgcattaggttgataatgatatgccttttcttgctgttcttactcattaaagactttaaactgctgaactgcatgttttaaaattgctttccaggccaggcacggtggctcacacttgtaatcccagcactttgggaggccaaggcgagcagatcacttgaggacaggagttcaaaccagactggccaatgtggtgaaaccccatctctactaaaatacaaaaattagccaagtgtggtagcacatgcctgtaatcccagctaatttaggaggctgaggcacgagaatcgcttgaatccagaaggcggaagttgcgacagagtgagactctatctcaaataaataaataaattaaaataaattaaattaaattgcttcccagatttttgaaaaacaagcacattctgagtcttccgtctcctatacacgaatatttcattttatgtattgacaatgatttactcagaagttcttcaacatatgttggttacgtgcattgaaactttacctttgctatatttcactaatctttacaatcctcactgagatatccaatatccaaactgaggcttagagagataaaatgaattatccaaggtcacatatttattaactgacaaatcttcactctatcgtaaagtgtttcctagttgtctgcaactgttatctccctttgtttaatcttttatatgatttagtgtttgtggaattctttgaaaaatgagataagtgtattgaattctagaattggaaggggtatcacatatcatattttgctagtaaatttttctcatttcttgcaataagagaaatatcttcttcatctcccccagtagcatctgtggaacctcaactcttagctgatgatctcacttcatattctcctggaaaatagaagttatcagataattgttaatctaatgtccccactaccaaatccactggtcaagttaaatctatcatgaactttatgaagatagatgaattaattctatcattctatttttttttttttttttttgagactgggtctcactctgttgcccaggctggcctgcagtggcacaatctcagctcactgcaacgtctgcctcctgagcccaaatgatcctcctgcctcagcctcctgagtagttgggaccataggtgtgcatcaccacatgtgactattttgttttgttttgttttgttttgttttggtggagacagagttttgccacgttgtccaggctggtctcaaactcctgagctcaggtgatccacctgcctcagcctcccagagttctgggtttacaggcataagccaccatgcccagccaggtctatcaatctttttaacatagttttacatttttttcttgagaattttttttttcttttagcttttgtgaaattgcctcctgcctcactggtcattctttctttgtctcttttgctgcttccgactacactgccgtatcagtaagtgttggactgtcccgaggcctgttctttggtctctttctctaaacacactcattccttggaaaagcccatctagtcccacagcttggaaatccacttaggtggattatacctgatgttatcttcaatcccttagccctcccttaagctcagacagatatcaaactgcatacctgacgttttcacattgatgtttaatagttatctaaaatatccaagacaggacatgtgattcccccaactcctgacaacctcattttcctctactatgcccatcttcatttatgacacactccctctagtcatagatctgatcattacctgatactgcttctcttctttctacttctaaatttaatataccagcaaatattattggctgtacttaaatagacatcttaaacttggctagttaacccatcttccttgctgccataccagtctaagctgccatcatcgatcacctgcatcacaacaatagctttctagcactttccttgtgctttcactcccctaaactatgttctccacaccaaactcagtcaccacatcattaaacaactacttattgagaatgcaccaggaattaggtactgtcctaagcattgcaaataaaatagcaaaacaaattcaaccagaaatctcttctttctttccatttgtatttccaggggacactcagtttatatatatgtgtgtgtgtgtgtacatatgtgtttgtatatatagataaatagtatatttgagacagtgatttaaaaataaagcaagatagagaaagtagagtgcagggtgagtggaaagctattattttatatagggttatgaagaaaggatttgctgataaggttatattttatacagaacctgaagaaaagtgggaataagtcatgtatctggggaaagagccatttaggtagaaccagcattaggagaaggggcctcacagcagagtcacctcggtgttttcagggaacacgaaggaggccagttggacagagtgggcaggaaggcattgtagtggaagtagcagaagacaaatcagataattatcagtaggtcatatcatgcaggctctcctataaaccattatgccttttcatttaacattaagccaatgaaaaatttttgagctacaaaacaacgtttttaccatttaaatacattactctggccactatgtggagaatgagtgggaagggtaaagcaggcaggcaggccagctgagaagtttgcatcatcataatctaggtgagaagttttgcatcaccgttatccagatgacataatggtagtttaaaccaggttgccagggctgtgggagggacaactggtcagagtctatgtacattttgtaggtaaagactacagctttcttctggtgaattgtagtgagacaccaaggctcttgacctgagcaactgaaaatgctcttattaatgagatggggaaaaccatggacggagtgggttttgaaagagaaaatagaatttggatttcagacaggaaatgtctgttagacctttaagtgaattctagtagatatttatgtaagtcagtatgaacttcagaagagagctggggactgcagataataatttatgagatgccaatgtacagatggcatttaaaatttaacttggataaaattacttagaatctaaatatagatgggtgaaggagaaatgaattccggggcactctaatatctcgaagatgaaaagaggaggagtagtctacaaagacattatttgttaaatctctacttattgattgatacactttatttatattttgttataggttgtgaatgtctaggtcttatccctgttttcccttttcttctacttcctgattaataattaaaatgaatcatcattaaatttatatagggatttactgccttctatttatgataacatattttttaaaatccctttaaaataaatattatttataaggtaaaaaacacaaacatgattgaggcatttaaaataagtaagacagagagacaaatcaaaaatattcaatagtggggaaaaatagtataaaggaagttatgtttctatacatccactgatagtcaagttccatattcatatactcaacaataggcaaaaattgtagagtactagcaatgtatgttcataagaattatacaactcacgagtttttgacctgagatcttaccatcgggaagtccctttcaataaatccaccaatttattgaaatggtatgcattatttttgcatttaagagcattttttcagaagagagaggggtgcatagctttattcacattttcttttctttttttaattttactttaagttctgggacacgtgcagaatgtgcaggtttgttacctagttatacatgtgccatggtggtctgctatacctaccaacttaccatctaggttttaagccccacatgcatgaggtatttgtcctaatgctctccatccccttccccaccaccctctgacaggacccgttgtgtgatgttcccctccctgtgtccatgtgttctcattgttcaactcccacttatgagtgagaacatgtggtgtttggttttcggttcctctgttagtttgctgaggatgatggttttcagcttcatccatgtccctgcaaaggacatgatctcattcttttttatggctgcatagtattccatggtatatatgtgccacattttctttatccagtctatcattgatgggcatttgggttggttccaagtctttgcgattgtaaacagtactgcaataaacatacatgtgcatgtgtcttgatagtagaatgatttataatcctttgggtatataccagcaatgggattgctaggtcaaatggaatttctggttctagatccttgatgaattgctactctgtcttctacaatggttgaactaataatatacattcccaccaacagtgtaaaagtgttcctatttctccacatccttgccagcatctgttgtttcctaactttttaatgactgccattctaactggcatgagatggtacctcattgcagttttgatttgcatttctctaatgaccagtgatgaagagctttttttcatgtttattggccacataaatgtcttcttttaagaaatgtctgttcatgtccttcacccactttttgatggggttgtttgttttcttgtaaatttgtttaagttccctgtagagtccggatattagacctttgtcagatggatagattgcaaaaattttctcccattctctatgttgcctgttcatgctgatgatagtttcttttgctctgcagaagctctctagtttaattagatcccatttgtcaattttggcttttgttgcaattgcttttggtgttttagtcatgaagtctttgcccatgcctatgtcctgaatggtattgcctaggttttcttctagggtttttgtggctttaggttttatgtttaagtctcaaatgaatcttgagttaatttttgtataagtgtatggaacaggtccagtatatgatttctgcatatggctagccagttttcccaccaccatttattaagtagggaatcctttccccattgcttgtttttgttaggtttgtcgaagatcagatgattgtagatgtgtggtgttatttctgaggcctctgttctgttccattggtgtatatatctgttttggtaccagcaccatgctgttttagttactgtagccttgtagtatagtttgaagtcaggtagcatgatgcctccagctttgttctttttgtttaggattgtcttgactatacccctaaaacatcgtgaaccactctaaatatacagctttcaaataaatttcacatttcttccaagtagagctcactggtaacattaaaaactcaaatttatactcaaaagacactggggataggggaacaaaaggaataagagccaaattgttactgattttcaacaggtacatttgaaagaaacagggttagagttgttattagggcagtagtgattagattgcacaaataactgggcaatgtcaattctcggtattctgtgttaccatttcagttctcagttttctgtttgaaaaaggacttaaatttttcttcagctgattttagttgaacatccccactaaatatggtagaatgtgaaaggctatttttaaatgtaataaaccataaaaaatgcttatggtctcagaaattctgcttgtcctcttaatgatgcacacgttggactgtgagcttgtggtagaatggagttagacttttgataaaggtcaaaatgttaataggacttttattttgtttctttgtaatccactctaaggtttctaaaactcaaaactctataattaaatttatctattgaaattctaaatttttgtcgatcgtcatgattcatagatattcttacacgaaaacaaacaaaaaagactccaaacaatgcaaaacaaaatattaaagcacaaaagaagtaattagactaaaaatggtacgttaactttgattactgataccaccgggaaaatacctacttaaaccttctaagcagacctcagaagacactctgtaatctaatgaaaattagttttataaagtcaacaggagtcctattataaaatagaaatgtatgaacaacagagtccaccatcttggctgttgtcttgaagtcatctacaacgatgagcccttcacgatgtttttctgaatgttctctactggacttccattcagaaataaaagatttggcagatggaatattttcattcttaatttaataaactatatgtcagaatttttgttgtgtgatgccttttgccatttttagtagatagtagcagctgtagaattaattaatgtgtacttacttctgagccaaaatatgaaaaacagaaatgataacccctaaattctcttactttgccaaatggagtatctagaaccatgccaaaagtgaatgttgagagaaaaaaaaaaagagaataaaagctctctaagcagctgaaatatttatcgaaaggccattatgctatgtctttctgctcttctccgagaatctatcagacaaatggttggataatagtgcagactttagttgacttcctggtccacagaaagtaagtcccacagtcacataacgaaagcagggaagtaggaggtgttagggaatgtatgactgtagtgtggctaggggaggggaggcaattcatagtctgagaacaaggggaaaaaattagaaacaaatttaattttataattggatttaagaaccacaaacccaaaacagtttggagctccttaatacaagttaaaaataccctagtggtattgaaagtagcacagaatacaatttatgttataatgatgttcctggtttattctaaaatttgaccatatttaatatttctgtttaaccacgagagaaacggtcaatgctaatgattcataccctgagaatcagtcacctattgatggaaatagccaacttgggagagagacagactagattttactttaaagtcagctatattttatatcagtgccctccaataaataatttatttttcttttccctgccttccccgccttctctgccttccctgccttccctttcttccttttctttctttccttctttttcttttctttttctttctttctttctctttctttctctctccccttccttccttccttccttccttccttccttccttccttccttccttccttcctttctttctttcttccttccttccttctctttctttctttttctttctttcaactgggtctctttctgtcacccagcctggactgcagtggcacaatctcagctcactgcaacctccagctccagggttcaagcaattctcacgtgtcagcctcccaagcagctgggattataggcacctgccaccatgctgggctaatttttgtatttttagtagagacagggtttcaccatattgcctaggctagtcttggactcccggcctaagtgatcttcccacatcggcctcccaaagtgccaggattacaggtgtgagccaccatgcctggccatatacgtaatttataatagacacattaagtaaaatgaagtaagtgaaattactttgaataatatattttctttaatttaatatatgccaaattttatatgaatatataatcaatattttaaaatatttatgaagtgttttacaatattttggtattgaatctttgaatctaatgtatgtttacacttacaacaaaagtatctcaattttggtactaaattatcacctgaaatgtttgatctgttcttagactatataaaatttactgttgaaaatgtaactatgtgcccaaattcatccaaacacgcttaaaattttctaataactgatgcaagcattagtttttaaataaaatttaaggcaagtaaacttaaataatatcaaaaattcagttcttgggttgcactagccacatttccagtacccaatagccacatgtggctagcactgcagtctttgatggtgctgtcctgtgtggatgtctttggacaagattctacagccccagtaaaaatgggatagcaaaaccaaagagtcaaggttttgaatagttagacataatatttaaaaagagtctatcatatactcatgactcaatgaataaggaataaatattttcatacaaaatcattaaaaaatgttaagaaaatgagttttagatttaaataaaattcatttacctgggatacattgcccagtgagacctgattaataagatcttaatggataaaataaatgtcaggtgatactgaaaaagatgtgtgaatgtacatgagaaactgacagaggaggtgaatatttggagtaatattcagaaggtcgctagatggtttaattttcttttttggaaacttcaatttcaagggagcagtaaaaggtaatctttaaaaaataaaattattaagcagagataagacactatctgattaataattaactttgtaaaaaggggcaatattttatcctgcctttctactaggaaactgtataattaaaaccacactatatgctattatgtatggcaattttaagattatatctctggacatatacataataagcaagttattttcagtgctctcatacagacatggcgcttaactactgaatggtggaaattttgttttaaattatttaaaattatatttaacagaggttgcatataattcaattgtaaacttgcttcttacataactttaccgtttcttcttttagctttagtgtaaaattaggcaaggcagaaactcacattatggaagttcccctgagaaaagtagttttctaaaagtatttctctttgttttcttgttcccaatagcgaaacgtttttgtaaataatggccgaaaacatcacgtaagatttgcagtatttaattcccttgagattaaaagaatattttcctttaaattagtggtaagttttatcaccttacatatacacagattcctagataaatccattgtatgattttcaaaatacatctttctgatatatttttatatttgatccatacctcattttttttttccgggcctgcagggcctgtactattactgtggttttctagatgagtaaaatcaggcatagtgaggttaagtgacttacccacggtggcttgttgacaatagggctagagccagaacccaagctgagaagccagtattttatccgcaattccttagagctaagttacaaagtatttttagtatttccactcgctccatgtcatttaagccaacaaataatgatttacataaggcgataaaataatgtattctacagagacagcagggcttggatagttttggagaaagaaacaaaatctcttaaaaactgacctcattgtttgagcttctttccaggaaacttttctacatgtactaattttcttgaccaggttcataaagccctgacaagtttatattctctgtattatttttcttctgaaccttctggggcagtaagagagcaatgatgcttgctgcaaacataggctttagaatctgacagagatcacctccctctgacctcagtaacactggcccctgctcagggcctcaggcctttgtgactcaaatgcaattagagattgagaagcacttccatctgtgtgcatgtggccacttgtgatgcaagacagaggcaggactgagaagacgagaggtgggcttcgttcctgagaatatccaggagtccaagagatctaaattggaagatggccttccaatttaggtcagtttccaattaagaaggccaggtttttatgaagcaatatttgtcaaggtaagagtatgatatggtttggatgtttgtcccctccaaatctcatgttgaaatgtgattcccaatgttggaggtggggtttggttggaggcattgaatcatgggagtagatccctcatgaatggtttagcaccatctccttggatgtaagtgagttctcacctcagttagttcatgtgaaatctggttgcttaaaagagtctgggaacgcccccttctctctctcttgctcccactcttgctatgtgacatgctggctccccttagccttctgccacgattgcaaccctcctgaggcctcaccagaagcagatgctggcactatgctttgtgtacagcctgcggaatcatgaaccaaaacaaccctttccttataaattacccagtctcaggtatttctttacagcaatgcaaaaacagactaacatagagtatatgagatattttgctcaaaatttttttgtttgatttgctaagtattcagacctatggaatatgagtctccacctataattttgccctgatccctaaaaaatgttggaggcagatcctgcaagcagaagagcatttgaattctaaactacttaaacagcttcataagcttaagcaaacaccttctatagttttattcttcatcatctttaaaatatggacaatcaataatagtattggctccttaggtataatggtagatgtggagtgttcagcttagtgtttagagcatttagtgtcttcttctccaaccatgagcaatgatcaatcttgcttttcatgggtttaatgctgattcttgttgccttgtgacatttgattgaaattatatatagaagaaggtgaagctgacttgactgagagtggatggatcacttctgagctgcagaaagaatgttaactgatgcacagtcataacctggagttaactgaacatgtcttcatctatgacctagtgtaggaccagagtgagtgacacagccacatccagcatcatgaccagatagatgatggaccaacaatatccatcagggtggatagaattcccttcctattcctgggagaaaggaaagcacctaaagaagcagtgaaaggcatgggaaattctttcttgtcctctgggtctgaagtcctatgacttctgtcagactttgcatatctccttgtcttcctaagtggggaatgtgggagatcctaaagcctaagacccaagaataacaaagtagagggaaaatgttcttagtgagatgggagttccatgaaatgtccaaaaggagaggaaaaagtagaattaaggaaagcaagagagggagtcaggggaatgtagcatccattgggctacattgaagaaagttggaggttgtattagtccattttcatactgctatgaagaaatacccgagactgggtaatttatcaagaaaaagaggtttaatggactcacagttccacatagctggggaggcctcacaatcatggcagaaagtgaaggaggtgcaaaggcacgtcttccatggcagcaagcaagcgagtgtgtgcaggggaactgccctttataaaaccatcagatctcatgagacttattcactatcaccagaacaacacaggaaaacccacccccatgattcaattacctcccatcggatccctcccacaacacgtggagattatgggagctacaattcaagatgagatttgggtgaggacgcagccaaaccatatcagaggtaaaactctctgctaattcctgggaaatgtgacagtacatctctgaggaagtatgacaaataaggaaaatgcatgtgtgtgtgtatgtgtatatgtgtgtgagagagaaagagacaggcagggagagagagagaaacagagatggagagttatacacgcctttatccgttttctacttagtgtgtctgcgaggttgtttgtgtgggtttataatattggtgtcggtaacaggtatttaacatttgtgagctcagggggaacttttaaaaacacaattctagcacaaaaatctttataagaaaatattttatttttaattttcacacagaaatgttaaatgctagtgcaaaaactttctagatatatctctaatagctttcaccaaaaatatattaatgaaactctttctgtcatcttgggatttttctcatagtgaatagactacttatttcaaggaagacttctaacttgaaataagattatccctctgtgactacagcatgaatcagtgccatttattaaggtgttaaatattattttaagcctagtctttggactccagttttgtgacaagccactcaggttggaggaaaatttgctcaacactacatccagaaattaaacttgaaattttcatttaattgggcatgaattcaagttattaatatttagagtgtttctccccacttgatatggtttggatctgtgtcctcacccgaatctcatgtcgaattgtaatctccaatgttggtggtggggcctggtgggaggcaactggatcctggggatggatgtcccccttgatgttctcctgatagtaagtgagttctcatgagatctggttgttcaaaagtctatggcacctccctactctctctcttcctactgctctggccatgtaagatgtaccttcttcctcttcaccttccgccataattgtaagtttcctgaggcctccccagccatgcttcctggacagcctgcagaaccatgagccaattaaatctcttttctttacaaattacccagtctcaggtcattctttatagcaatgaaagaatgaactaatatagactaatatacccctctaatatacaacatgtttgaaatatggtataggaaattagccttttgccccaactataaaaattttataatcaaataacaaattaatgaacttaatagtcattgacaaaataatcaatgataacataccaactttagcccatagatttgaaggtgacatcttcactgtatgtacccatggaaggctagtcccatagccctgcccaggtctttcactgtagagctgaaatggtgaatagatagcctcagtggttttcactgaggtaaacactaaattagtgagcactagaaccatgctactttgaaattgttgttatgtgaggcaataactgtccttattttttagactgctttcaatgggctttatatagcttgaagttgtaggtaacgtgcttcataaaactaacccttaccaaagaacgagctagtgcaactatcaccccatttctaaatgtttgcttttcttatatcaaataataaatgctattaatgccaataaagattactaaaactatatactaatatgtgttgctgatgataccattttctaataactattactatttaatatttttcttattactgtcaaattgcttactctgctacactctcttccagtgtagttttatcactttgcattcctcacagcaatgtgtgagagttccagttgctttgaatctttgatagtaattgctattttaaaaaataggtaagcaaaaattttaaaaatataatctaacacattaattaattgcagttttcaatattattaaaatgtcaattctctccaaggaatatggagatttaatgcaatcccaaccaaaagcacaaaagacttttttaaaaatagaatttgacaaggggactctaaaatgcatataaatggaaatggcaaaaaactgctgagtcactgttgagaaacagagcgttgttctacaagatacacagactaatatttaaactacagtatttagcatatgttgtgttggtgcagggataaataaaacaatggataagaacagagaattctgtttaattcaattcccaattgaataaccaatagaaatgcatccatatgtgcacccaaagatatgcacaagaaagtttctgatataatttttttttaatcctaagatttattggtccttacttagggaaatatctgttgatgcctattagcattagcttattaatcccacacagcatctttccaaggtaaatactattaactatcccattttattaggttggtgcaaaagttattgcggtttctgtcattaatggcaaaaactgcaataacttttgcaccaacctaaacttaagaaggaactgatgtttaaaacagatccacagcccaacaacgcacaaacagtgtggtggaatctaactcagcaatctctgattccagaattcaactatcaacttgctggtcctctacttcccgaaactctccagcctacatttcttcctcttcttcggtttctaaactcaaactgactttggaatgaaagggagcagctgctgaggtaggaaggtcggaggtggccctccaaaagcctcttttctggaagctccgctgccaagggctcgactggagtcccaggacatattcagaggccgccagacccctgcatggaggcccctcccttgcagctcctggttaccatgattgaatgatgtcctgcagctccgagcctcagccacctatgttgtcaaggtttcctctgtgaaagcatccaaaaactctgccagcaccttcttctttccttttttgttttcctaccagggccaggccaggctctgctggccatttccgattaagctcctcagaaggcatagagccactcacactcagaattatttaaaataacactagactgcaaatgccctaaatatccatcagaaataaatggatgcataacattgggtgaaagaagccatacacaaaggtgtatactatatgattcaagtcaagaaattcttctgtttttttaacaaacacaactaaggagccgtaattgtcattacctttgggaaagcaagaagatgtgggggcttggaggagtcacaagggaggcttccagtggtagtcacatgggtccctccttttcactaattcatcaaatagtgcctttgtgttttttctaaatgtgcaagccattgcattagtttcctagggcatctgtgacaaagtaccaccaactgagtggcttaaaacaacaccaatttattctctcagtgttggaggctggagtccaaaatcaagcagccagcagccatgcttcctctgaaacccttccatgcttctccttaacttctgttggtgaccattgttccttgacgtccctcggcttgcaactgtgtcactccaatctatgcctctgttgtcacatggtttttttctttatatttctgtcttcgcatctttttttttttaataaggacaacagtcatattggactaagggccctccctacactaatatgatgtcatcttaatgaccctatttccaaataagctcacattctgagatatttgggattatgacttcaacatatctgttttggggacacaattcaacccatagcactcctcaacaaaaaagtaggaaaaaaaaaagctttagtctaacctcctggctgtcaatcttgcaatatatactttcagctttctctctctctctttctatctccctctctctcttcgtatctattcatagatcatactatactcaatgctttgatgatgattttttaaatttaacaatacattgtaagagtttttcaaaattattacacatttttgtattatattaatgctgtgtaatattccattttagggacaccatactttttaaagtaggtctctgttgcagtacactgggatattttctgatctttttaataatatgaacagttctgagtagaacttcttagtagctcagtcactggatatatccataacaattatttgaaatcagttcctacctatagacatctatggagctactgcagaattacatgtcttgataaccaataacaaacagaagtttggtacgctcattccagtttttattgccatctgtggtgtgtgagaatccctattcctctccctgttcctctcacccactttggcaccagtgttattattcctttttaattttaccaatttttttttacaaggaaaatgtcatctcactattttaatgtgcacagtgcttacttttcaaaactttcttacacatatgtatgcaactctctagtttacaaaggttcattcttctgctctgtaaactgtttcctgtgcttaatttggaaagtgtgaaaggccaaatttttgtcattagagctaccatttgaaatagtttctgagcttttaaattttatcaaccaataaactataaagataaaaatagaactgacacaagattgtcaaataagacatcattattttgccaaataaagatgtaaaatgcaaaccaataaaaactttttcaaaccatctttttttaaagaagaggattttttaatacaagaaatagaatagcataatctcaaatttaaaaattgtttattacattgaacaaatatagttttaagaaaacttgctataattgtttctatttttcacatacattgacagacaatggaaatttcactgggaatagcaatgtttcttggatcggccatgattacctcagtgcaattatactgctattcagccgaccacatcctcataaagccaggtcacttgaaacaatgtctgtctgggtgagttttggaggcaattggcagtttcctttaggtactgtcagtacaatacattgatatatttagactgggatgttgtagacatagctatgtgtgattatgcctatttattcttgatattatctttagggcttctgaattactaagaaaaatctagatgtcattaggctcctgaatttagatctctgaatagcaaccaaagaaactaatttagacagcatagtctcagcttggagaaaattctactcttaaagccacatttgttgattcccttggaaaacattcttttttttttttttctcgagatggagtttcactcttgttgcccaggctggagtgcaatggtgcaacctcgactcagtgcaacttccgcctctcaggttcaagcgattctcctgcctcagcctccccagtagctgggattgcaggctcccgccaccacaccttgctaattttttgtatttttagtagagacagtttttcaccatgttggcaaggctggtctcgaacttctgacctcaggtgatccacccacctcggcctcccaaagtgctgagattacaggagtgagccaccgtgcccagccggaaaaacattccttaaaagtgttttacttcccaaagcttgttccaaaggctgggcagattctacactgcaggtatcccagaagctgaagaaggaactgcccaataggacttatttgcactcttccttaaaatgtcgcggtgtggagttgtgttaacacttcacgtgtcctattgctttccctagatttgtccagcttctgccacttactaagagagagtatgtgtttccgaggcgaattgcctgttgctagctgagattagcaaagcttcgatagccaagagtaaacattagttctggctactgctttttatccttactttttatctggtctaatgtcaacacaaattctcctattactgtctttcaaaatgacttgggaatattgcggttcatgccaaaatcaacatgaaaataaggtagagcatattctgtttgggctgagagagcaataatatattgttgtttttcttctgtctgcacatagccctacatttaggcactttagcatgtccagccaaattttgcttcctaacataggtttcatgttcctgtagatgttttgtgggatgctccttcggtattaaaatgtgtatttcaagaggcagccgtagattctattaagcgtgtatgtaaacggagaacaaatttttcccgatctttatcctttctttaatgtagataaattcattatgagttgtgccctgtgtgggctcagtggcaggaacttgcgagatgcacacattcccaggaaatgagtttatttgctcagtaatattatataaatatattgttacccccatttaaaaagtcaccctaaacacccataatgaaggaagtgcataagctctgactctttaggtcaatgttttctgtgctaagccattaaaagagcatttaggaaaggcttaaccttactgaaatcatgtacatttatgacactagaacgctaagtctgttaacaagtcagtcatgcacttggaataactgttcttccaggttgagtgtctctctcctcaaaaccacaataccacaattgctataaatggatttataatgtttagcaaaaactaaaatgtgtctacatttgaagaatggaatggaggttttaaaaaagaatttcgtgattcagagacagttaacagtcttctgacctggaagaggccaagatagcaatttcaccagcagaaccttgagtaaatagaacagcagttattgttatttccactcagggggaaattacttcccttgaattgtcgtcaagaggagtggttctgatgatgttcagacctgcttctgtgtcttgggaccaggccaggacatcgcaggaagggccagccactgcagcatcaccctctgcggtgctcagagctacctctctgatgttgtggagacagagctccttgtaagccttaaccataccatggtactcaagccaatatgcccaccatttgcaagtgcagcatgatgtttaggatataatggggatttgaagtaggaggcttagttttttttagctgtgtgttagttatttagacttggttagtcatgtgatatggaaatcaatctgacattccctacaacctagggtctatacatagtatctgaataaacaaatttgctctccaattcccatttcgtagtcattctttaaacacatcttaactagaagcagaaactattgtttcatgaaaatggctatacacttatatatactttaatacacttatgtatactttagctaaaatgaaatttgtaattgtgtctgctctagtgtataatacatgctctcatatataaaataataattatgatggctttttgtaatcattattatttaattacaatatgttaacaataacaataataatactcttatatttcacagactacttcaggtacagattataataagataactcaaatctctacctttaataggaatttataattttgggctatgtgttccagatgccaaagtctcctttaaactatcataatttatgagaatttataatatttaaaacaaatgaaaactgttttataatgaaataatttaattaatttgtgtgtgaagtcaatgaatttctaagactgaatgtccggtttgcccactctgaatactcttgcatgactggtagcaaaattggtcctcacacatcaaacataagctttcttctgatgctagaaaggctgctctctaggaaagcaagagtgagattcaataaaatcctggtctaggtttgagtatgggctacgctacactgtcatgtgtgagctggagaagtcttttggcttctccatactttggcttcttaaattgattcatttatttggcaatgataataatgttctaatggggctgttggaagactaagtaagatagtgaatggagagtcctactcaatatctgactcataggttctcagtcaaagcttttatcattattatgtgatgccacaatgtttaggcattgtctcaagataaaactcagggagaattgagtacaacaagacaagatcgagttgtactcattttccatttttcaaaaatggtttttgtactttctagattatagaatctgtgctgaaaacttggatataaaaaaattggatattaaaataatggagattgatattaaacaggtaatcagataaaaatcacaaatgctatttaaaagggagatttatttccttacattttatattaaattgtttagatttgtacctctttcatttagtttacaccaataaacattcaagatctaccccaggttaactgtcaaaagcccttattataagcccattactactatagaagcccacagagataatgggttccaggacactaacattttggagttacttaagcaaagacgctgtcaatgacaggagcctcctatatcaaatctactcacttgagatttaagatgtttcaattttgtaagaccaatagtttctatttcttgctttctgatcccactaattgtaattctcatttgtgaagtctacctaataaagacttttagaaagtttaactcccatgtgcttcaggacctttgtgtgcaagagggtattaagatttctgctttcatatctgagtagtattcatgatgaaagatgccctaatgaaaacaaattatttcatttagttcaattccctgaagtaagaaatttttggatccttgttctaagagaaagtataattttctgcaatttgtgaaaaaagattagttttactatgattaccccaaattcttgttctgtgtagacagatcccttatctgattaatgatgaatggaataggatccagtcagtcccctggcttttctctttttacatgtaaaacaaaccagaacatctttcatattcgctttgactgacagactcagagaatagagctaaactgcaaaaacaaccggggtgcaaccaaaaagagctgtcgggtgaggaaatgtctcaactctgtgaatggcctttaaaatcctgcatttgctaagtgattcctcagttttattaagaaaacattaattatcctacatgaattaatttttactatttcaaagaaaacacttagcttgtttgttggttgagtatggtttttcttcatattatatttgttttattaaaaattacttgtaatacaaaatttgtattttaaaataaatcaatgagtttatacaaattttgaaattatttgggcttatgctaccaactacttatttatatttactccattaactatggagtttataaatttataaataaattccataaaaagccaatatgtgcagagagggttttttaagttaggaaaatttaaggtacagtgaggctccccgtaaaatcatcatgttggaaagtttcaccacagtaactgttggctctccttgtacccagttcatcctggatatctgtacctgctcctaccaagacaattttcagcaaaggattctaccctatgtcttagtgagaatatgtttgtcaacattgccatttatcctgtgtgaaagaataagcagattattttatatttctgtgccacatacattttctttctttcttttctttctttttctctttcttccttccttctttctttcttctttccctccctccctccctttctttctctctctctttctgcatttgctaagtgattcctcagttttattaagaaaacattaattatcccacatgaattaatttttattaattttctttctttcttctttcttttcctttcctttccctttctttcttcctttcctctttctttccccttcctccctccctcctttccttcctttctttctctttctttctccttccttcctttctttctgtctttctctctctctctctttctttcttttctttcttctttctttctctatttccaaagaaattaaccttaaagaaatggtttaaagaatgagttctgactcatagaactcagtgggacagatttgattttcttactccaagcctcataagtttatcctcttttccactcttggatgcaatataacttagtaagacactggacttgaagttcttcctcttactctgtatgtgatcctatggaaattagcaccctgagtttcatttatcttatatttgaagagagtctaataatgtttcttgtgttaactaaatatttaactacagaatgttggcaaggagaagctgaaaaacaggtgttaacaaatcattttaattacaaactatactaaatttatgtactcaaaacatcataattgttactaacaataaagagggcagaggctgtaatatggttgggctttgtgtccccacccaaatctcatcttaaactgtaacccccataatccccataaccctcataatccccacatgttaagggtgggaccaggtggaggaaattgaatcatgggggtagtttcccccatgctgttctcatgatagtgagttagttctcacaacagctgacggttttataaggggctcttccccgctttgcttggcatttctccttcccactgccttgtgaagaaggggccttgcttcccttttgccttcggctatgattgtaagtttcctgaggcctccccagccatgctgaacagtgagtcaattaaacctctttcctttataaattacccagtcttgggcagttctttatagagtatgaaaatagactaatgaggctgtcctcaacttcttttgtattcctctaattttcaacacaaactggaaatttttaggagactcttactgaagtatcagactaataatttcactaattggtaacatcatgaaattaaatctgaaaatactagagaattctgggaaaatgttataaaaataaataatcttagggaaaactgtagttttattgtcaataattttaaaattttgagaattggtgttaagtaacctgagttctcatacccttttctgtggcatgatttatcaaacagattcaaataaaatagtctctaagatcaatgatctcaatcttgatttataaaataataagatatttgtttttaagataaattattaaatcttaatcattttaattgtgatatttgataataatttgtatttgaacatttacagcattaaattcaagctatatttctaaaaattgcatttctaaattatttcgtatggaaatctggcagacttgtttgtctataacgtaccaaatcccagaatgatgctaagatataatatttcctaccaataattctttttttgacatgcttcataaagttttaattttcctatattaaaactatccaaactagaatctgagcttcagagtgaaagcgagggttatcaaatgtgtctaatttgtagccacaaggcacagaattaatttcagactcaaatgctttggggagggaagaaaactttatatcatacatgccaactaatcatgattaggttataaaagattgccaaaaagcagtttttgagctgcactttccccctcagcatcacgaacctctttttctttctctatagattttacatatgtatgtgttatacataatatataatcagtatatattatatatcatatatatgtgtatatatatataatcaacacaaatttgtgcacaaacacacatatacacactaacatgcatacaactctcgacatatatgatcaggtttcactcaacttttactactgttattaaatatttgtctcctagcctctcagtatttgtgtgttcatgtttcttcacctccagaggaaaggaaagaaaatgtatgtggcacagaaatataaaatgatcagcttgttctttcacacaagataaatggcaatgttgacaaacgtattctcactaagacatagggtagaatcctttgctctatattgtgctgtgcagtattggatttggcgatggcacagaggaggaggaagagagaagggtcgggaggaaacattcctttctatcaccataagatccccgttgcatgctctgtccttgtggatctgactcttcggtctttaaatacactttattctacacagtctatctgatactatatatagacatcaacctgctctctatatctatctctcattcgtctttgtatctaccacctttttaaaaaggcaacttgagacagcatatgaaaaattatacaacaaaattaaaatgagaaaggttaggaaattgagttaaaggaaaaagttgactggggaaataagctgaggggaatgataatttaagtttaaaaaaatgctacctatttacactcccaagaggcattccagttgttagtgagaaaactggcaggggtgaggggcttgtcccgtcccctgctctgtccccacaatctcttcccagggactcatgctcctttccataaacacttgcactgaaactccagtccagtcctgttctttctcatgcagagaattcattactatttgtcttctcaggcatctgttccatgctttgccttactactcttataccagctactctcatcccaatttcttgttgcctaacattgattctctcacttcaccacctaatctcttttctttctggtccaaacaagactctataacttcaatccatacagtcacgctgccggcaatttggatcaagaaagaaccttgtgcctagtgccatgatgatggtcaggagaggacagacatatttctaaaatcacaggttggaactagatatttgttccacctatacagggaaatgatactgtctatatcttatctgaaagctaacatataaccagaggaaattttaacattcaagtaattaacactttaagatttcatgttttgtctttcaattatgtgatgttttaaaataccatatgatagataaaatgagagcattttagagtgcaaaagcgtcttttaagaatatagctttcccaaacacctacgtacctcagtatctcccccaaagaaacaaacacagaaacaagagaaataaaacaaattcaacctcttcattgtctgcatcaatacatactacttttcgcccccctgaaacacagaaatgatgaagtccctgtagaattaactgaaaaataaagacaaaaagactagaggagaaataaatgatcagttatcgtttctctttctggctttccccatagctttttcaaaaaccaaatggagaaaagatatatttgttattcagatattttactgtaaacattgtgctcaacagaaatattctagattatctttgtcatagcaataagtaaaattttcaatgaattattccaaaatttatttcatctattctttttgttcatagacagactcaaattatgcagggtgatacttctttatgatttatgatgcaattactttaaaaaataaaactaaatttaagatttttaaactattaaaatagtagtagtattgtagaagtacataatactataatatgatgactttataataataatgccaatagaaattaaaagaaaaaaatcactactatcctgagtcaccaataaatcaaccgatttgaacaatttttgtgtttttattcagtctttgcccatagacttcacaatctatgcagcattaaaatcaaaggcttataatttttaaaaagtaatgtggtcattttcctatccataaatgagtgattaaaaagtttatctcatgacagggtttatatatgaagttaaggttttattcttaaaaaatatagttttggaagaaaaatgattttctagtaatgttagataaacacgaaatccaggattacacaaaaatgtcatgtaatttattttttaaagtttaggcaacaaatttttaaagtttatttgccatcatttccttatcatagagtactctaggctggaggcaaaatcttcaggattttgcaagcacttggaattttaattgttacgattttatgtttccctcctcaaggctattgattctgcagcatattcatgaaatccttccacctggttcaatcataattttaattggaatttgttttagtaaatgtttagtaaattataggaaaaaatatttccaaatgtgtaataaaggaattatatatatttaaacaaaagcatgacttggtttcattgaaataaacaaaatgataaggtagccacacatggccaatgtctcttgtgtcttttccatctaaattacattaccagaaataaatcagattctgaattgtctggcaactggtggtgagagaaaggaggggcacagattatgacagatgaaatggacaaagattgtgtgtgtgtgtgtgtgtgtgtgtatgtgtattgtgaaaaagttgttgacgattttattgtgataggtttgtagactagttttttaaataattttttcatcagaaagttaattttgcttcttaccacacttacatgaaaattctacagtatgtgtaaaatagaagtgtgtttctatatatgcatgtgtaatagctgacgaagaaaaataaagagttgacagaaaaaacggagtatatcttacatatctcagaaataaggagaacctatatgtcccagaagttattggtcatggtaagtatgtaagaaaacttataaattaaattgaaagttatagatcaagggagatttgatagctattattttcttcctcttaaatgtcatattatatgtgtatattaatgcctgtgtgattaaacacataattcagtacaattatttacttatcccaaagttaagacttggactttcttgaattcatggctattactagtggtcttcataataatgataatgaaattatcataataattataatagctacccagtatccacagtttccactgtctaggtcctatgtcttacatacatgttttcatttaatatgttcctaatccctgaagtagaaattgctacctgtcttagaagagaagatcccaaggctcagctagttcacatagctggtaagaggtgggcctaaggacactggaaaccaatggtattgtaacatcaaactgacaaggccacgtgacagaaggatttttggtactagctttttgtcaatgtcagtgaagttctaatgggccatcaatgcaaaattatatggaataaacttacatacttagattaagtgataataacagacaaaaacctagaatttagaaatttctaaacgtgattgtttcaaaattccaatttagaactgttttcttatgacctctagttagtcattaagatatgtggctatattgacacacgattataaatttagttaaatctaagttttaatcatctcttcttactgtaaagatttagacaatatctatcaagaataacataatacctaccaatattttatctactgataacatagtaacatattttcataacttacttcaaaatatgataagagatatagtttaagtttctggcaagttcctgaatgccatgctgtttctgattttaaaatatctctcagatcttaaaaacattaatagaaacaacatggtcatttagtcacaagcattttcatttgtttattgtacttctatttttacctaatctaagtactctcagttcttgatcagaacccaatgttattaaatattgatatttactctcagatatattttatacaacacctaacataaatgaaatgcttgccagaaaatattcattcactttacacctacaattctttttcagcatacatgtacaaaaagcttttggtccaaataatagagcctgacaggatttgccccaggtaggccctggaaatgttttcctttgtgctggcctatttctttgtcactaagtctggaaaaaggaacttttccagaacttttcccttgtgtggcagtccataaaagaggtactataaaactgagctaggcacaagttatttgaccatatgacttgtataagttgtcaaaaacacttttatttaggactggagttttaattttatttttaaagactacgttgttataatttatattttaagtgtttggctagtgcttttacaaattaaaacaaatcagctattatatagaaaaatacacttttgtacatgcagcattaaaaaaaagaaaacgtaactaacttctttcaaaagccataatggagatgattctacttagtccacttgacattccttgacctttgttactatgatgaacaccacccatttaaagcatctatgtcaccaagcattttaacttcgccatacagctcagtgcttaacggcacataatggtattccttgccaaaattatacataacccacccccaaaattggtagtacgcatcaccatacatttcacagtatagattctaaggtaacttgaatatgaggatgaattgggacaaagctctacttacgcaaatggttccgttgaatgctgagtttgacctgtaacctgcaaattttggaacatggtcagaatagaacagtaaacagttccggatatttgctaatgtatgttcaccaagtacatggaattaatttaaatacgtattttgaagccactgtttcttcaaggtacttatatttgacataaagattagtaatcaaactatttttaatagaacacatgtgcagattttagttattgatcaaagtataagattaaaaggtcagttcaacatacagaaattagtaaaaaataaaaagtacctagtgtgggatttctctatgatattgctatggtattataatggatttgttgaacttgagctttactttacttatatgttgcatgatatgcacaaatattatcaagtgagttacacagagttcagaaaaaaaaaggttatctaatggcaggagtatcacttatgccaatatttacccaaagccattctattccaattaaaaaactagttattgcaaatgaataagaagcagttcaacaaacagaaccatataactggcttgatttttgtttcatctaaaactaagcatttttcttttatttatgattcttatttgctgtctttttttccctttacctctaatcctcaatgaattttgttaaattcagacctcattacatcttttattaagataaccctaccattgcttactgagttgcttgatacttttaaaagaaatgctagacaaaatacattctctccaggaaattcctaaactctaacctttcagggtcatagagagcagcagtttgttggtttggaaagtgacctgagttcagctcttctccaaacaaaccttcagatgttatctgtgtgttggctcagaagactgcactgctaacccatagagatcaacagtagcatgttttatcactttttagctttccgtgaatgacattcatagggaaggaaatatatgcatcgtacggaaaatgttcaaagattcttgaagactttttaaaaattccacatttagcaaaagaaatctatttaaaaaaccaaaaatatcaaacagaagtttataaggctaaagtgttaaagtcctaattaaatctatacacttcttatattgaaattcaatgatcaatatattctttagatagctattccagaaaaacaaaagttgtggaacaatcagtgttttcagttgagaagatgtattaatatggctatcttaaaattgcaaacaattcactgtcattgaacatttttataatgataattcattttagaagacaacttgcaaagcaaattttaaaaaattcacggggcatgaggtaggtaatctgagaagttttatttcctccttgtgaagtttagagatttaatcactcataaaatgaacaacgtttactggagtgaagggaaagctacagtgaattctagaagcgttttaagaaaacaacattttaacttctgtctgtgccgcaaagcagcttcacaaaggtgcttgctgttttatgtattgtttttctcccgaaggttcaaacttaaagatcccaacatggccccagctgtaaaagcacatcttccagtttaaattagattgacaacttcctatagtcagggagcaagtttcaagctttaagactacatccacacttagtcaaaaaagtcactttccaaattaattttaaacgggaaaattaagattagaaccagtgtctaaaggtttaggacactttaggacactctattaaacatattgctgggacataattttaatatatcttacttgtgttaaattgttttctcctttgtgcaagtgatttgttttctatttatcaactgtgagttagaccatcttcaattaaaccaacaagttattttattatttggggagtgatgaggtttgataattggtacttatattgattctgtgtgctatcaatgaaaacctgagttaccatatttgacatatttagttttttttttttcttttttgttttttgagatggagtttcactccgtcacccaggctggagtgcagtggcgcgatctcggctcactgcaacttctgcctcccaggttcaagcaattctctgcctcagcctcccgagtagctgggatcataggcaagcgccaccacgcctggctaatctttgtaattttagtagagatggggtttcaccatcttggccaggctggtcttgaactcctaacctcgtgatccacccgccttggctttccaaagtgctgagatgacaggtgtgagccaccgtgccccgccgacatatttaatttaacatgctgttgtacagcaaacacatagatgcaccaaaaacatgctgacataatttgtatatattttgtaaaatgcactatatatttttaccccttaaagcagccttgtaatacagaatcaaattctctaaaattagacaccgggaggcagcactgtctggcatcttcccagaaacagttgccagttgattctgcctccttcacacactcattactactcccgagttattaatgaagcactaataaaatcaaactcttcaactgtcagattagtcagcagttcacaatgacaaagccctgctttcctggggctttattaggtacccgtgcctatgcacatcagtgttcatggaaacatctcagaggcaaactgatttgaaaaactcagtggcgcttagatttagcagcaggaagcaacgcaaagtgactaaaacaatctataactatttttaggagtaaattttattaaagactctctaatttttttttttaaccaaagagacattatcttattttgcggagtaaacattaaagcacattttggatttttgttctttggcacaatggccttaattttatcaccatatttctttgcctctttgaaagtttccttttattcttctccctttgaatgaatacaatgtatttaattccctgtttcctacttctttcggcagcaacactctcaaagaatttttctcaaagaattcacatgaggctctttgaaatggttttggaacagagcaatttacaaattctcaccctttcctaaatattgtcagaagatcactccctttagttttttgcattactcttcagaaatacagcctttgacaagggaaacagagcttacaaattaaataatctgtacaccatccccctgtgacatgcaatttacctatacaatgacacacaatttacctatataacaaatctgcacatgtacccctgaatttacaaataatttttttaattaaaattaaattaaaagaatttggcttaaggaacttatttttatttttaaaaccatctccgaaccaaattacgttttgaaacacaggttttcaatcatattattgacacaacagtgtattgccatcagttgtgaggggaaaagcaagtaatttgttactaataatactgtatagcattttgtgaattcatttcagatctttaatgacggcagacgttttcaaaagcattccagagtgtgttttaactgggagagagaagggtccagttggtgcaagtgtgctgggaattgtgcattgtgttgaaaccatgttatctacactagatagagtaaccactagactgagtaaccatcatgtgtaccattaacagttgtggaagttatgaattattgtagaatttttttagatgtcatgttatagcttgttctgccttgaaaaaattgcttatggataaaaatttttgatatgagagaagacaaggagagatgaaggaaacaggagtagtaccaaagtgtctactgggttgctacaaagcctcattgcatgctaaggtgtaccaccacagttgaaggctgcaaatgatcaggaatgccttaaatggcttaaaacatcttggaataaaaagtcaaaaagaacaagaggaatgctgaaaatttactataaaaatttgaatgtataaaaacattctagttatttcatgtgaaataggtgatactaagaatgatagctataatcatgaattcaaaataagtgattatttaaatatttaacatttttattcatatcaatatatcttaaaaatatctaaaatctaaattttctatgtagataatgatatataatttacttattcttgctttgtaataaataagcatgcttactttattagtgataactctgaaagccccataacatttatatttattttttcaactgtaattacgaaaaatgctgaacataaacaaaaacagacagaatagcataataaacccacatgtattctcgatccagttcaacagttatcaactcacagtcaattctgttttatctgttccaccaaccacttccccataaccatattatttgaagcaaatcccagattgtataagtccatccataaaatgtttacattacccaaaaagataagaagtctttactcacacaattatagtgaagttcatttacctaaaatctataataattactcattaaatatcaggtcaatattcaaatttccaatgatctcatgaatatcctaattatatgtatttcaatatgactgaaacaatctcaatgttttgtgatggttccatttctcttaaatctcctttaatctatgggttcatcttcttcttcttctctctctctctcctttttttaaacctcatacaatttactgttgaagaagctgggaagttattttctcccagtctgaacatcacttattgtatccctgtggtatattttaacttgtttccctgtcctcttatctaaatatgtgattacacttagatttgctttttccattttttggtaagatttgtttatgggtgataatgtgttatttcaaccagaagcccatgatatctgcatgttcctaattttgtgaggttagcagtagctatgcttaatgtgatgatctttcaataaatatcttaatgctgtatggtgggactatttttattctattatttcttctttattaactgaaatatttataaaagaagaaactcatttattgatttggctattcagtggcacagtgcacaggagaggttgggtaaatgtttgagtctttacctatatgcaccagctattcaaaagagtgagtcagttctctactatccagaggtgaccagttggctaagttatgttagtatcactcactatagctatttgaatataaacatttaatgtattgaactatttatactcaaatttcccatatcaggctatgggagccacttcaagatgactgctgaacccgttgggcacaacttttagactttcgttattttcttgataactggcctgaaagatggtctaggattttcttgaccatttcttgactaagacctggaatcagccattttttttttcaaggatccctagttccttttaatagaaacaaatcttagtcttgatatcaactctgggtgatattgaggcttattgttatgtggtgggtcactgtttctagacttgtgaaatagatggagctaggaaatataatgttaagataaaatacatcagtagtatattgatactttgaattaaagaccatgactatgggagttttgtttaaaaccttctattttgcatttgtttcttctttttcccaaacttagaattctagttctcaataatacctgaaataatatccttaacatatcacataattactcatctactttatttaattatatacatacaaactctaataatagcaccgaaactacttgcaaaaattggctgctgaaagtagggtttttttcagttaataagttacatccctttgacaatgcctagtcaaattattgtgttttaatatcatttgtagtcattcttccatcaactaaatacatattttatttctttgctttattttatattagtttttttagagattgctttttttgaaaaaaaagtttataattatgtaaaaaatttccatgtagttccaaagtacaatctacaaaactagatatgctctagtctagcttgtcaccgtgttgtatcgaccctattccttgtctcttgctttagctaaacattttaaaaagttattatttatcctttcattctttaaaacttcagatatatacacaattatgttctcacattacttatataaatagcaacattatatatcgatatctctatatattctttttacaatttcattgtcatatttgttcagtcttttattgtgtttgattcaaaagagagtaactaaaaagaaaaatgaaaacatttatttgattaagtcagaggaaacaaagaaatttttccaagtctttgacactgcttaaagctttatgtatatttaaaatgaccttgcaaatactaacagaaatgacatgtgcttcaaaagaagcaccatcatatctaagatggtgagaaattagttatgaaatgagttagaatattcagtgatttggtcagagtggttgaattagttagtggtagttttttattgattgatacttatctattatttttaagatgtaacatttagtaacgaagctcaaatttggttgctttagttctattttattgtgagaaagaaaaataaactaaaatctttctctcaggtaaaaaatacaaatgtcataaactgattgattaaagccccaaagttttatttaagtgataatactcaatgtccacaaaagtaaggagagattaatatcctccattattgatgttgagatcatgagagtgtaaagtaatacggtattttcagggtcatttagaaactgttctacctatgtggtgaaggtttgacctagccattgcacttctaaaatgttatcctaattttttttcatacaggtgtgaaagatagtatatacaagcatattcacttaatgttttgtaatagctacctcctgccataaaaaataaaaagaactcatcttttaccagaagcatttttataaattaaggtttatcacacaattaaatgctacatagccatgagaaaatgaactatatctacatattcaaagatggctaagatgtatcatagagtgaaaaaaatctttaaaatctatagagagaatatagaaaattataccaattgttaacagggattaactttgagaaatggggcttggaggtgaatgtgtgtgtgtgtgtgtgtgtgtgtgtgtgtgtgtgtgtttatgtgtatgtattttgggagaggcaccatattatatataattgtgcatgggcttggaggtgaatgtgtgcgtgtgtttatgtgtgtgtattttgggagatgcgtcatattatatatgattgggcatggtttggatttctacatttacatttccaatagttcttttaagtatttgaatttttctttaagaattgcaactaacagccgggcgcggtgactcacgcttgtaatcccagcactttgggaggccgaggcgggtggatcacgaggtctggagaccgtggctaacaaggggaaaccccgtctctactaaagaaaaaaaaaattagccgggcgtgctggcaggcgcctgtagtctcagctactcgggaggctgaggcagaatggcgtgaacccaggaggcgaagcttgcaatgagccgccgctgcactccagcctgggcgacagagcgagactccgtctcaaaaaaaataaaaaagaaagaaaagaaaagaattgcagctacatattattaaaatgatttccatctggtagcaacatgcttgaattgtaaaaaaaagaaattaaaaaggaaataaaactcatctatactaagaaactaaagtgataaattaaaaagcacagatcaaaaatcaaagttttcatgcatttaacagccatgccatataataaaatacactggagctaatgatagtagaatcgagcccattacagttctttggttttgacaaatttaaacaattatctttcagcactcctccacgttatcattttaaacttttaaaaatatagaaagtgagaacattagggaagataggggtaagaaaatcaggcatttttttcacatcttgtatatatatatacacatctctctctctctctctctctatatatatatatatctatatagaaaaaaatatagagaggcttgctaccttcagataaatgactttttgcactatacacacttttgttaaaaaaaaaaaaaaccaaggcagagcactgtggctcaagcctgtaatcccagcactttgggaggccaaggcgggcagatctcctgaggtcaggagtttgagatcagcctgggcaacatggtgaaaccccgtctctaccaaaaatacaaaaagttagctgggtctggtagtgtgtgactgtagtcccagctacttgggtggctgaggcaggagaatcgcttgaacctgggatcaccactgcactccagcctgggtgacagagcgagactccctctcaaaaacataaaaataaaaataaaagcctaaaaataaaatttccgtcttcattgaaatagactactaaggaattttgacaattataatttattattactattattatattttaattaaaattcttggcattgaatgggctcagaagggggttggtttccacaatttaagattccaaagaaattccatatcacaattttgttcaaggaacagtttacataggtcacgttgtgcagtggactgaaccacaggcatgcagacagcgctggtgtgaatattttaggctccagcaacatactgcctcaacttctagccctgtttcagtgtttctcattggtaaaaggagattttagtcttatagatgttagacttctcttcaatatcacatgctgcatgattctaggtagtcaatataaaattaatcaataagaaaatggcaaatatcaattaaatgtgtggtgaaacatttacttaccaagttctaatagtgttagagacagagtcatggaaaaatgggtcaagccagaaaatgttctctactgcaggagtctcagattcagacatctacaggtaatttggatcagtaaagggtgctggatttaaggcaaaagaaatggtgaaggttgtggcagatatgcattgcatccagcggcttgtcgccatataggaatgtggatcgtgttgatacgtttttctgattttcaagagaagtcaagaattaggactgtttcatgaaatttctcaatttctaaaatattgtgatggttaaacaaagcatgcctgtggcttaaatacagactctgacttgcccatcagtgactcctatttccagaactgtctatgaaaacagctagaattagtagtatagtcatttcctctttgggtgaatctgtggttttgaagatcacatcattaaaatgaaatgaaacataaatgtatttgtcacacttactcatatctaaaaggaaaatgaaagcgaagatggtggactacattttcctgaagccactgtatagcttagaaagtggaaaattacaacttaacagatttgcagtactggttttggagtctcatatatacagtatattcctaaaattatttataatttctgattatttataagattatttgtgatttctaagattatttatgattatttatgattcctaagttatttatgatttttgtgtgtaatgctggagctcaatttctaaacaatgcctatttatccaggcttgatgcactacaattctctctggattacaattctatgatctagctttaggccctttctttgcaaaacagagaaaggcatttgagttgcttcatttaaagcaataattaaatatatggcaaaattacaggagacatataaaataatacatagctgtaatcattgactcatatgcactatcagttatagctaaaatatacagcaaggacctgtctgtaccatgtgtgtttcttattcccctcacaaagcaatcatttggggagctttatgtattaaacgtactggccacaaaggactttatttgggaatgctgctgtgcttgctctggcatagattttcactctgaaaatgtctgttgagatgtgatggctcaaatgttttcatttccaatagtatgtcatggtacatttttcatatatataaagttttggtgccgaagattggtaaatatttttacataaaattaaaaactaatagaaaaatggagaatactatactatcttaggcttattcctcatgttacacaaagagctttcttcagcatttaaataaatactgcaaatactttcaaggtaagatttatgttaacactgagaagaaaggatatgttgaaaccgttttgttcatttaatcaaatgtaaacaatcattctagaacattcagattatgatacatagaacttgaaatgatccaaatttcctacactcctttatccaattagtcaaatatttgccaattttctcatacagcaatagttgaacaagcctatattggccattttatatggacagactgtgaaatctcagaagctcttccattggtcctctgtgatacacatttgctctcggaggtaggaaagtgtggtagcaatggaaaatgtgtgtgtacagtggactagtaacaaacactgtctccaagggccacaactcaggaggtgatacaactagtccaaagatgtgtggcttgtgttttgcccataagaccaagtcattggaaaagcttcaataaaaattgtttttaccacatttagctttcaggttaatttgtttttgctttcagatgcaacatatccttgctcttggtcttacaggtaatcaaccaaagaataacaattaggtttaacaatgcggaagaaaacactaataagctgtcagaaaccaatgtctatctgtagcctctgagaaacagagtctgtatttgtgattggaatacacagggcatggggaaatatggtaacattcacctatagccaaaagttctgagatcagcagctctctctaccttctccactacagcacccagtgctgaagagtgcacattgtaggtgtacagtcaagatttgctgatcgaatgtggctaagtgcacagatttctcatacacatacttttctatgacaccttgtttttcataaactaggaaatttcaccttgtacaagttataaattcccattgttaaaaggacagagacaagaaaaggaaggacattttaaaagctagctattctgttccacccattaatattttgttataatatcacaagactaaattgtaataaactctgtttcagctacgaagagcactggccaaatagccaaacagaaaagtgttaaactgagtatactgggggctttctgaaacactgctctttgtctagctaaatatatatatatatatatatatatatatatatatatatatatatatgctcacacacacatagagaaatatacacacatttttttcacaatttcaaattactcaaacatcgtatttgatgattctttgccttaggggaaaaaattagggtaatgaagaagctttaaaagacaaatatactgctttatttgttttcagaaccatagtttttgctgattacaaaagttctggcactcactggttattgcagttttaatatgcattaatattgttattaattaatatgcattactttttctggttttagtttttcagttttcttttcattatattttttcttttttcttgtattgctttaatgttacttgagcaaaaatatggatagaatgatgaattttaattagtatgtcttttattccagtgtaccattcatacacctctttgttacacatgaaaaaataaagaaaactatggatgtactaaactttaacttttgaaccattgctacaatttgacatatgctggaatttaatccccaaggtgatagcactaagaggtggggactgttgggaggtgattaggccctgagaattccacgctcatcaaactctatcactttgacccttccaccaagtgagggcacagcatccatcccttcctccctgtgagaacaaggtgctatctcagaagcagacactgggcccttggcagacactgaatctgctggtgcattgatcaatgaaaatcgatcaatttctcaccttccagaactgtaagaaaaaattgtatattatttataaattatgcagtctgtgatatgttgtcataacagcaggaatggactaagacaaccattaatgttaatatttctcatttggctgtagttgataattaagtattatatattagagaaaagtacatttataatctgtccctaaaagcctgaaaccttgtcaagttgaaagaaagaaagaatattttgacatattgcaagaatgttaagagaaatgctaagaattcttctttaaatttatctcattagttgatttgcttccaatgtacagtaagaaaaaaataagtgtgcaacattttcataaatgtaaacctcacagagaatggatcttcaataaggctatatctataggacatcaatttagaggttagagtcccaaaaagtattgtcataagacatcttaacaaataattgaatttctaaataaaatacgttgatagttttcccatgtgagattttttttttttctgatggctaccaatatgtcaagttcatgaagacagactcaatatacaatagatccattcactgaatgcagattctaggtgagacaaatttgagttgtgtcaaaccatcgagatgatttacacataaccttctaaaactaagaaacgtgcctgcaactagtcatatgtcatttgggtatctgttttacagattgtgttttatttttttaagttttgtaataatagttctaaatatttatacaagtaactgtaagctgtagttactgttagtcattatttttgtcatatgttccaaaaggaaatattattttgatttcttcagaaacaaatgaaaatgcaatgtataatagttgatatatcagcaaatgaaacacctttaaaaaataaatttcctcaagtagcaaacacggtgtcaagaactacgtaaatcaagctgtgatcggtcctgcattcttccctgtcactgggacgtcacataagtctactgcacttccggtactttccagttttatgagtaattttacatgcaataaaacttcttcgagctcttcatttgatcggggatgactgtgcagcactattggtgtccaatagatcatttctggtatggtttcttgcttggccattgccagtttcaaactgcattgaatccaaagattctaataagataaatatatttctctaatgaccttacaacaaataatccagttaattttcatttctgatattttaaaacttggaaacactaataaattgtcttttacttaaaccaagtaaatgtaaatgacactgttcagtgccacaatttgaatcttataaatatattaaaacaattttttattgtgcactaatgtcagcatgctttctaacctttgtaatcagtatcaaaccctatagtataaacattaagtatatgagcatgaaattgagagcctaacaagcaaacacgatgatgtcaaagttaaatttaaaattgattatattgaaagaaaaacttgctgtttgactttattgatcagttagcaaaatcaactttatacattttctaaagaaataaacagttcatcaccacttagtggatatttcaaatgttttgcattacagttgcagaaattgacttttgtggctattagtagtcgtagtaatttttagtattaatattattaggaggaggcagcacattatttcttaaaggaccagatggtggtattttaggcattgcaggccagaggtctttaccacaaatactcagttctgccatgatagctttcaggctatcatggaaaagacataaatcaatgagtgtggctgtgatccaacaaaattttgtttacaaaaacaaacagctggaccacaagtgatagattatcaacctctagatcagtggcatttcatagttctgtagtgtttttatattttcacaaacaaagtaacatagctatcttgtgttgcctaggcatggacattcacttttgcagatgaggaaacaagaattcagagttgatttgcacatacgaagcaaaacaagtgagatccaagcctccagactctacaacagatgcttccaatatctatgtctaatgaagtaaactactctgaaaatcaaaatgtgtattttttaaattaataaaaactttctttctacctcattctgaaatttgtcatacaagagcatgaagacaaaataatagcacaatctcagatcccagcccatggatctgacatatgcttaaaatttaggaatggaggcccttagccatgtttaggaagactcatgcagacacagaggactagatagctgttgctacttcattgagaagagtcaattccttattcaaatactattaaaatatttatagaatgaattaatacataaacaactttaaagacatgattaaatatgttctgaaagaaataattaggaatgataataacaacatagttttatgtacatactgaaccatttggattcaatttattcaacaattacaaaacaattattgaacacaaggtctgagttagatatttctggagaagctgagaagatccaggcataattcctgttttgaaaaggctaaaatataaaagaaagacatgggaatttttaagggcaatcaaaagaggaaatgtatatgttagacataataaaagtgtaggtttttaaaaggtaagtgaaataatactatatttaaaaatatatgcaatggtcaaaatatactttatttttttcaatctactaactgattattaattacaatcttacaattttgtttaaaggtacatattatttaagaaaaagaagaaataaattagagaaacaaaaagaatcagagtcaatctgaaataaaaacagatgctaaatgccaacatctttttttggatactgcaaagaaagttatttccatacgtggattttgtagcctgcaactttactgagttcattaattagttctaataggttttttttgggggggtgtctttagggctttttacatataagatcatgtcattggcaaacaatttttttcttcctctcttatttagatgccttttattcctttttcctcttaatagctctggctaggacttctagtatcatattgaacagaagtggcaaatgtgtgaatccttgccttttgacagatcttagaggaaaaactttgttttcctcagtgagtatgatgttagctatggacttttcatacatggcctttattgtgttgaatagttccataccgaattcattgagagtatttaccataaaatggtattgaattggaaaatgctttctcacatctattagataatcttgtgattttatccttcagtctgttaatgtgatggaccacagttattgatttgtataggttgaactggccttgtatcccagagcgaaatcccacttgggtccttccaatatgctatttaatttgattttctaatattttgttgaggatttttgcatccatgttcatcagggatattgtcctgtatgttattttttgttgcagtgtctgctctagtttgatacttggtcccaccaaacctggtgttgaggtaggacctagtgggaggtgtttggtcctgcgggcagatcccttatgaatggctttgtgccattcttgtgatagcgagtgagttctggctctactagtttccaccatagctggcagctgaaaagaacctggcacattcccctctttcttgctttgtctcttgccatgtgatctctgtacatgccgactctgctttgccctctgtcttgtgtggaagtagcctgaggccctcaccagtagcagatgctggcatcatgcctcttgtacagcctgcagaactctgggccaaccaaacttcttttctgtatgaattactcagcctcaggtattcctgtatagcaacactaaacagactaaaatggtatccttttctgactttggtaccagggcaatgctggcctcataagatgggtttggaattgtcttagttcaggcaattataacaaagaccatagactgggtggtttataaaaaaacagaaatgtatttctcacagttcaggaggctggaaatccaagatagaaaggccaccatggtcagattctggtgaagatccccttttgggatgcagactgctgacctcttgttgtatcctcacattacagaaagaactagagacctcatgggagtcccttttacaagggtattaatcctattgatgaggctctaacctcatgaactagttactttccaaaggccccacctattaacacattacattgggggttatgatttcaatatatgaatttgggggagaacacaaacgtttagcccataagaagtgttctttcttctattttttggaaaagtttgttttaaatgttctttaaatatttggtagagttcacctgtaaagccatctggtcctgggcttttctttgtttgaaaattttgattatggcgacagggccaagatggcagactagaagcaacagcatttggaggctcccatgaaaaaacacataataagcatgtgaatccttcaccagcaaccaaagtgtacaggttctctcatcaaaattgactagaaggttggtgtgatccatggagagaaggaagagcagtgcaatgtggcagcccagctgagagccacactgggaaggggaacctccttctcccagccaagggaggcagtgagtgagcacgctatccagccagggaaactgcttttcctatggaactgtgcaacccgtggaccagaagatcccactcctgaacccatgccacaggggactatcataccaagcccagatgtgcatattcttacagcctcttagctggaatctgcttaagcctactgaactcctgggggagaggtgactggcaatggctgcagctgcctgctgtctaagccttttgagctcctttggggaggggcagcagccagcactgggacttgcaactgcctaacacattaagcctcctgggcagaggaagggcggcacccatttctatagctccagactgtgcttttctgctgctggagctaaggaggctggatggcttgatcccaagacttgttcccacaacccaacacaccagctgtggcagtttgcagccagagtgtgtcttcaggactaaccctgacccatccttcctcagtggtcagggcttccctgcaagatctccaataactccagccagaggtgcagggaaagaatttggatctcccggggcctgagcccctagagggagggatggccacagtttctgcagaccagcagacttagcttctccttctggtagttctgaggaatccaggcagcccagattgagtgagtttccccccagggaaacacaccctctccaccaagggacaaagtgcttcagtaaacaagtcctgctccccatgccatccaactgggtgagaccctccaacaggatttgtcagacaccctatacagaaataatcctactggcatcaggttggtgcctctccaggtcagagatcccagaagaagaagcaggcacccatctttgctactctccagccttcttgagtgacatctccaggcatgacagcaaatcagatgaatagggcctgaagtaaacccccagcaaactgcagcagccccacagaagagggacctgactattgaaagaaaaacaaacaagcagaaagtgacaacaaaagcatcaacaacaacaacaaaaaggcccccacaaaaaccccatccaaggatcagcagcctcaaagactgaaactagacaaactcaggaagatgagaatcaatgaaacaatgctgaaaacccaaaaggccagaatgcctcttctgcaaatgattgcaacatttctccatcaagggtgtagaactggatggaggatcagatggacgaattaacagaagtaggcttcagaagacaggtgataaaaaactacaatgagctaaaggaacatgttctaatccaatgcaaagaagctaagaaccttgataaacggttagaggaattactaactagaataaccagtttagagaggaacataataacctgatggagctgaaaaatacagcacaagaacttcataaagcatgcagaagtatcaactgccaaatcgaccaagtggaagaaaagatattaagaatttgaagaccacctttctgaaataagacatgcagacaagaatagagacaacagaatgaaaaggaatgaacaaagcctccaagaaatatgggacttcataaaaagaccaaacctacaattgattggagtacctgaaggagacggggagaatggaaacgagctggaaaacacacttcacgatattacccaggagaacttccccaacccagcaagacaggccaacatgaaaattcggggaatacagagaacatcattaagatactccacgagaagatcaaccccaagacacataatcatcagattctccaaggttgaaatgaaggaaaaactgttaagggcagccagagagaaaggccaggtcacttacaaagggaagcccatcagactaacagcagacctcttagcagaaagtctaagaagagagtgggggccaatactcaacattcttaaagaaaaaaattttcaacccagaatctcatatccagccaaactaagcttcataagcaaaggagaaataaaatcctttccagacaagcaaatgctgaaggatttcattaccaccaggcctcccctgcaagagctcctgaaagaagcactaaatatggaaaggaaaaacctgtaccaaccactgcaaaaacacaccaaaatataaagaccaatgactacacaccaaaatatagatcatgaagagcacaccaaaatataaaaactacgaagaaactgcatcaactaatgtgcaaaatagccaaatagcatcatgatgacaggatcaaatgcacacataacaatacaaaccttaagtgtaaatgggctaaatgccccaattaaaagacacagactggtgaattggataagaagtcaagacccatcagtgctctgtattcaggagatccatcttacatgcaaaggcacacacaggttcaaaatagagggatgaaggaaaatttaccaagcaaatggaaagcaaaaaatagcaggggttgcaatcctagtgtctgacaaaacagactttaaaccaacaaagatcaaaaaagacaaagaagggcattacagaatagtaaagagaacaattcaacaagaagagctaactattctaagtatatatgcacccaacaaaggagcatccagattcaaaaaacaagtacttagagacctataaagaggccgggcatggtggctcacatctataatcccagcactttaggagggcgaggagggtgaatcacccgaggtaaggagttcgagaccagcctagcaaacatggtgaaaacctgcctctactaaaaatacaaaaaattagccaggtgtggtggcacatacctgtaatctcagcttcttaggaagctggggcaagagaattgcttgaacccaggaggcagaggttggagtgagctgagactggggcactgcactccagcctgggcaacagagtgagactcagtctgaaaagagacagacctacaaagagacttagactcccacacaataatagtgggagactttaacaccaaactgtcagtattagacagatcaatgagacagaaaattaacaaggatatttaggacttgaactcagctctggataaaatagacctagtagatgtctacacaactctctaccccaaatcaacagaatacacattcttctcagtgccacatggcactgattctaaaatcgaccacataataggaagtaaaacactcctcagcaaatggaaaagaactgaactaataacagtctctcacaccacagtgcaatcaaattagaactcaggattaggaaactaactcaaaaccacacaatttcatggaaattgaacaacctgctcctgaattactcctggataaataataaaagtaaggaagaaatcaataagttctttgaaaccaatgagaacaaagagacaacctaccagaatctctgggacacagctaaagcagtgtaagagggaaatttatagcactaaatgcccacatcagaaagctggaaagatctgaaatcaacatcacaatgaaacatcacaattaaaagagctagagaggcaagagcaaacttatccaaaagctagcagaagacaagaaataacaaagatcagagaagaattgaaggagatagaggcgcgcacacacacacacacacacacacgcaaaacactccaaaaaatcaacaaatccaggggctggttttttgaaaaaaataacaaaatagatagaccactagactaataaagaaggagagagagatgaatgaaatagacacaataaaaaatgacaaaggggctatcaccactgctcctacagaaatacaaactaccatcagagaatactgtaaacatctctacacaaagaaagtagaaaacctagaagaaatggataagttcctcgatgcatacaccctatcaagaccaaatcaggaataagctgaatccctgaataggacaataacaagctctgaaattgagacaataattaatacccttccaaccaaaaaaagcccaggaccagacagattcacagctgaattctaccagaaatacaaagaggagctggtaccattccttctgaaactattccaaacaactgaaaaggagggactcctccctaactcattatatgaagctagcatcatcctgataacaaaaccaggaagagacacaataaaaaaataaaatttcaggccaatatccctgaagaacattgatgcaaaaatcctcaataaaatactggcaaactgaatccagcagcatatcaaaaaacttagccaccacgatcaagttggcttcatccctaggatgcaaggctggtccaacatacgcaaatcaataaacataatccatcactgaaacagaaccaaagacaaaaaccacatgattatctcaatagatgcagaaaaggcctttgataaaattcaacatcccttcatgtcaaaaactctcaataaactaggtattgatggaacatatctcaaaataataagagctatttatgaaaagcctacagcctattgagtgggcaaaagctggaagcattccctttgagaaccagtacaagacaaggttgccctctctcaccactcttattcaagattgtactggaaattctggccagggcaatcaggcaagagaaagaaataaagggtaaccaaataagaagagaggaagtcaagttgtctctgtttgcagatgtcatggttttagatttagaaaaccccattatctcagcccaaaagcttcttgaactataagcaacttcagcaaagtctcaggatacaaaattagtgtagaaaaatagcaagcattcctttacaccagtagtaggcaagcagagagccaagtcatgaatgaactcccattcaaaatcactacaaagaggataaaatacctaggaatacagctaacaaaggatgtgaaggacctcttcaaggagaacaacaaaccactgctcaaggaaataagagaggacacgaacaaatggaaaagcactccatcctcatggataggaagaatcaatatcatgaaaatggccatattgcccaaagtaatttaggttcaatgttatttccatcaagcattgaagcattgacattcttctcagaattagaaaaagctattttaaatttcatatggaatcaaagaagaccctgtatatccaagacaatcctacacaaaaagaacaaagctggaggcatcacgttacctgatatgaaactatattacaaggctacaggaaccaaaacagcatggcactggtacgaaaacagacatatagaccaatggagcagaacagagacctcagaaataatacaacacatctagaatcaactgatctttgacaaacctgacaaaaacaagcaatggggaaagaatctcctattcagtaaatgatgctgggaaaaatggctagtcatatgcagaaaacagaaatggaaccccttccttacaccttatacaaaaattaactcaagatggattaaagacttaaacgtaaaacctaaagccataaaatccctcaaggaaaacctaggcaatatcactcaggacatagtcatgggcaaagactttcatgacaaaaatgccaaaagcaattgcagcaaaagtcaaaattgactaataggatctaattaaactaaaggtcttctgcatagcaaaagaaactatcatcagagtgaacaggaaacctacagaacaggagaaaatttttgcaatctatccaaaggtctaatatccagaatttacaaggaacttaaatatttttttttcttttttcttttctttctttttttttgagatggagtctcactctgtcacccaggctggagtgcagtggcacaatctcagctcactgcaagctccgcctcctgggttcacgccattctcctgcctcaacctcctgagtagctgggactacaggtgcccaccaccacgcccggctaattttttgtatttttagtagagacagagtttcactgtgttagccaggatggtcttgatctcctgacctcgtgatccgcctgcctcggcctcccaaagtgctgggattacaggcatgagccaccgcacttggccaaacatattttcaaaaaaaaccaactccatcaaaaagtgggcaaaggatatgaacagacacttctcaaaagaagacttttacgtggctaacaaacatgaaaaaaagctcaacatcactgatcatcagagaaacgcaaatcaaaaccacaatgagataccatctcacaccaatcagaatgacgattagtaaaaagtcaggaaacaacagatgttggtgaatctgtggagaaatagaaatgcttttatattgttggtgggaatgtaaattagttcaaccattgtggaagacagtatagcagttcttcaaggatctagaaccagaaataccatttgacccagcaatcccattacccaaatgattataagtcattctactgtaaatacacatgtttactgcagcactatttacaataacaaagacttggaaccaacccaaatgccatcaatgatagattggataaaggaaatgtggtacatatacaccatggaatacttatgcagccataaaaaggaatgagatcatgtcctttgcagggccatggatgaagaaggaaaccatcatcctcagtaaactaacacaggaacagaaaaccaaataccacattttctcactcataagtgggagttgaacattaagaacacatggacatagagatgggaataacacacaccagggcctgtttgggggtcagcgggtgaggggaagaaacttagaggacgggtcaataggtcagcaaaccaccatgccacacatatacctatgcaacaaacctgcattctctgcacatgtatcccatttttttattagaagaaataaataaaaataaaataaaaaataataaaataaatgtaaaaaagaaaatttagattactaattccttttactgctagattcatgctttctatttcttcttgattcatatgcatatatatatatatatatatatatatatatatatatatatatatatatatatatataaacaacaaactatccaaaaaggaaattaagaaaataataatcttggctgggtgtagtggctcatgactataatctcagcactttaggaggcggaggcagaggtggatccaggaaaatccctcgagctaagaaattcgaagccagtctgggcaatacagtgaaactttatctctattaaaaaacaaaaattaactaggtgtagtcgtgctcctgtagtcccagctactcaggaggctgaagtgagaggatcacttgaatctgggatgtcaaggctgcagtgagccatgatcatgccactgcactccagcctgagcaacagaacgagaccttgtctttttagaaaaaaaaaaaaaatctcattttcttagcacaaaataaaataaaataaaatatctaggaataaacttaaccaatgaggtagaggtttgtatactgaaaactataaaacactaatgaaagaaattaaagctagaaagacttcccatgttcatagattggaagaattaatattggtaaaatgtccatagtacccaatctgatctacagattgaatgcagtgtctctcaaaatcccaatggcattttttacagaaattgaaataacaattctaagattcatactgaatcacaaaagatcctgaacagcagccaaggtaatcttgaacaagagaaataaaactggaggcatcctacttcttgatttcaaaataatataaaatgtaaaatatattacaaagctacagtaatccaaacaaaatggtactggtataaaaacagacatataacccaataagcagaatagaaatatcagaaacacaccctcatacacttttaaagttatatggttaaatgaaatcagacctttatcttacaccatacacaaaaattaactcaaatggtttaaatgcctatatgtaaaacctgaaaccataaaatttatagaagaaaacatagtggaaaatcttcttgacattgttcttggcaatgatttcttaagtataatactaaaatcaaaagcaactaaaataaaactagataattgtgactatatcaaacttacggcttctgcatggcaagggaaaccaccaacaaaatgaaaaggcaatctgtggcatgtaagaagtatttgcaaactgtgtatctgattaagggttaatatccaaaatacatagaaaactcctacaactaaatagcaaattataataataatcctgtgaaaaaataggcaagggacctgaataaacattactccaaagaagacattgaaatggcaaacagatatatgaaaaagtgctcaacatcactcgtcatcagggaaatgcaaattaaagccacagtggcatatcaccttgcaccagttagcatggctattatcaaaaatcaaacaataaatattggcgagaatacggagaaaagggaaccctcgtacactgttggtggaaatgtaaacttgtacagcctctatggaaagtagtatgaaagttcctcaaaaaattaaaaatactagcataaaaacagacatataaaccaatgagcagaatagaaatctcagaaacacacacacatacacatttaaagttatatagttaaaatgaaatcagacccttatcttacactatacacaaaaattaactcaaatggtttaaatacctatatgtaaaacctgaaaccataaaatttgtagaagaaaacatagtggaaaatcttcttgacattgttcttggcaatgatttgttgaatataatactaaaaacaaaggcaactaaaataaaactagacaattgtggttgattgtctgattcggcaatcctactgctgagtatatatttaaaaatattacattcaagatcctaaagagatgtttgcaaccccatgttcattgcagcattattcacaacaaccaagacatggaagtaacctaaatgtccatcagtgaatgaacggataaagaaaatgtgatatgtagatatacacaatagaatattattcagccttaaaaataaaaggaaatcctgacatttgccagaacatacatgaacttggaggacaatatgctaagtgaaataagccagacataggagaacaaatactacgtgataccactgagatgaggaatttaaaagagtcaaactcaaagaggcaaatagtagaatggtgcttgttaagggccggtgatgaggggaggtaagaaatgagaggtattagtcaaagacttcaaaacttcagttgcagagatgactaagtcctagagatctactgtacagcatagtgagtgcctatagttaataatactgtaatgtataattaaaaatttgctaagtggataggtcttatgtaagtattcttaacactaataataatgataataaaatacatagggcaggagaaaagttattttcatggttttataaaaaaagattataatatactttttaaaaatgtacactttaaaagtttaaatcagtataaagcttacacatacctatattttaaaaactaaaatgtaaacttatcaattgtttttactgtagaaatgtaaatcccacagtttatcttttaaaatgaaatgaaaattttgtattacaagcataatatcacattaaattggaagcattatatattaatcatctgctatgtatttaagcaacataaatttatcttataatatttttattttaaaattagagttaataatttattatttgactaatttatcaccatatttaaaagctttgttatgaaagaaaagttacacatgatactgggaactttggatttttatttcccgattttctatttgtgggaagggaggagaaggcagatattttgatatagaagaaaaagtgataaagtatttaaggtaatgggatgtaatgaaaaactggtaacaatatatttcaacctctttaaacaattagtttaaataggttttctaaaatacaaataaacagtacttcattacgtactttcaattatgtcaatcactaattttttgaaatttgggttctcccaatacaattctagtttcaacttggaaaagataaaacacacaagaagaaaataggaaagaaaataggggggagaggagaaaggcaaattaagatgtatcgtaatgctaagcaggaaaattatgaatgataaaaatatttaggttcctttggtcttttccttcagactaatacatttgataacattcttaacctgcccccactatctctcaacccaattttgagaggacagaatgacgtaactgctaatagccctgattcacatccttaatgactgtctgaaaaaaagtttgccatgatgtaggatatgaatcatgctcaccagagaacatctcacatttatggtaaactgtggcctgcttgcaagaaatagaaatgttaattacagtcatttcacttcataaaaataaacgtttcagagtttttgtactctcaaattatttcctaatgaattacagacttcgtctataaatgtgcactcaaatgtaaagttactgtaatacatatatatcaatgtcattataaatttctgttccaagctaaatggaaaaatatcagggtccctggaacaatatcaatgtgtcataattgaacatttatacaatatttgtagaccacctattaattaattatatacaaatgactgaaattctcctgtaacaatattaaatatgatctttagtaatcacacaatttaaaattatactttctcttttattatcttgtacacgcatgtctttcttatcagtgtacttcattgagtaaacactagttggcttaattatcttactttttgccaggaagtggatgtgagacacttttgtgggtgttcttaatatttttgaacttcattattgcttatttaaagaatagcttcctgcgtgctcaataacatgtgcatttggattgcatcaaataaagttagaataacttaaaaggaacacaccagagcacacttattttttgtttgtttaaaggacaccgagtttgaggaaacgtacagaaggaagagaagtcactggaatctgaaaaacaggatggaaagaataaaagctgtgctaaggtaattcattggtgccttcttagcaatctctgattttcccatttaagcctgtatttcttttcttttttttccaaataaattttgttgtatatatttaaggtataataataataataataataattattattattattattattattatgttgagatggagtcttgctcttgtcgcccaggttggagtgcaatggcatgatctcggctcactgcaacctccgcctcccgagttcaagggatctcctgcctcagcctcctgagtggctgggattacaagcacccgccaccacgcccagctaatttttgtatttttagtagagacggggttttgccatgttggccaggctggtctggaacacctgacctcgtgatccacccacctcggcctcccaaagtgctgggattacaggcgtgagccaccgtgcccggccaaggtatacttataagatacaaatagacaataaaaaggttattatagtgaaacgaattaagatatccatcatctcacataattacccactttttttttgtttttgtggcaagagcagctaaaatctactaatttaacatgaaccccaaatacagtaaaatgttattccctatagtcctcatgttgtaccttagatctctggacttgctcattctgctttcagtcctttaattactaaattgtgatccttgaagtctgattattttactttataaaaattatttcataaaataatcctcgactcaattcctcagccacgggaaaaaataaagtaattcataggtttggggatcgttttacttttttgaggctaatttatgttaatagtaggaaatgcagggttccaggagcctcaaactctaatcttaaataagtccctagttcagattgccatctcaggctggtgagccgtcctccctacccttcaataatcaatctgacaattttaaggacaaggatgcagcatcatgggaggccaagaaaatactcaaaacattcctagagacttgaaaatgaaactgattagagtcatactataaagaaattgaaagggggtaagaaacaaatgggtaaatgaaaagtgttatttgctgctaataagaattgacacgactcttctcagctcttcactacctcacattttagaatcattaccaaaaagttctttccctcaataaccttattgctatcaactttgaaaaaaatcaggaaactatgaggatataaaatatatcagataacacacttgctatttatttatttattatttttgaggcagagtctcctcctgtcaccgaggctggagtgcagtggtaagatctctgatcattgcatcctccacctcccgggtggaagcgattctgctgcctcagtctcctgagtagccggtggcacgtgccaccatgcccggctaatttttgtatttttagtagaaacggggtttttgccatgttgacaaggctggtctcaaactcctggcatcacacacttgcaatttagaggagacttttctactttctaataaagtaatattgatatgtataaaagtgtttatttgttcatagatatctttaggaaatcgtggtaacattgttgctatgtgccaggtatgatcatggcaagtcacttaatctttttcttctccgttgataaattgataaactaaagcttataataggagcaacctcataaatgtgttatacaaattaaatgtatgaatgcatgcaatgccctttcaaaagagctcaggagcaaagtaagaactcaataatggtagagatttttattatgattaaaattaatatttgttaggagaaacaagaggatttaaataatgataggacaataaacactggggacttctagaaggggtggtggggtgaggaaaggcttgaaaagctaactattaggtactatgctcactacctgggtgatgggattaatcccgccccaaccccaccatcatgaaatatacccatgtaacaaacctgcacatgtacccccctgaatctaaaataaaagttgacattatttaaaaaaatgaaaaaataaataaatatctatcggtaaagtgctctgggcattcaaaggaggaagagattctttcttccaaatgtcactggaatgcctccctccttcctccattattatctcagaaggtcgcttacctgctgaagagcttgagtttatggttacacagacccttaggtccttaggtccactcataaagaatccttcagcaagctaattgatctcttcgagacctgacttcttatagcaatatatataaaatgtctggtacaaaatcagtaatccatgcatatcgatttctcattaaaaggcccattttaatagaatatgaggctgattgaatgctgtttgggggtgttaggagaaaagaagtcctgaaaaatcagagagaatttgctcagatgaaaataattcagttgaatttattaaaagaaacagtaaattggagaaaataataaggattattcaaaacatattagtcatgtttagtgacctaaaaaatgttagtactgtatgtgtaatctatgatgagaaaaatgtcaaactttggagtcttcagtgttttcaatgatcactctgattttcatttttaaaattatttcaatatgtatgtatgaccttttgtgaaaatactcccacagggattaggaatgctgattatttttctgtttgtgaccattaagaagggaaatgactatttcagaccaggaaaagcaaccaagttcatgatgatgactgtacagtgtagtattatcgattgatcgatcgatcgattgatctatctatctaatcaatctatctatctaatgtgtgtatgtatatatatggcttatatatctatatggtttatatatatgattatatatctatatggtttatatatatatggtgtgtgtgtatacatatatatataaacccctccacacagtgacttttagtaaaacgaagtcttttgttagtgagaatttttttcaaattataagagaagtaagcttttgaaaattcagtgatagcacagtaaaatgaaaaaaaaattgacaataacagaaaagctcagggaaataataaaaatatattagtaaaatatttacagtgtaatataaatacactattttatgtttttatatactttataaacttatttatatattttatacatattttatattacatataaataatatatatttatataagtgtatgattttatatatgattatatataaaatatataattatatatatacattcatatattatactactttatttatttctatatcctttatatagttgatttatgtttatatattttatattctatatgcttattttactattttgctcttttttttttttttagtctccttaaacactgttaacctttcagatcattgttatattatctcaaactcatggaattctagtctatgaactggctaagcttattcactcaagtgccagattgtctaggttttaattccatgtctgccatttacagcttgtgtgatcttgagcaagttatgtaacatctctgcacctcagtttcacattcgaaaactggaataacaataatgcttagctcacagagttgttttaaggattaaaatagtttttaagtaagagcagaagacctgaaaggacctgtggcatggagagtcggctatcatcactaagttcttacctcccccagactgggtttcttttgcttgcctcttcatggtatctggagattactctcttcttcctctagcaaagctattcatgaaacatgtaacattttatgtagaattgctaggtgtttgcagttggagggtttcctgttagccaagcttggcatcttgctgaatatggaatccattgaggatatttcttatatctacattgggacagaacttctaccactgttaaaggtaaaagtttatgttagtttaacttattttcttttactgtgtggaccttttactataggcccagtatttatttatttatgcctgcaaatgatccccaatgtccacatattcaatagaactattacactgcatttattcttaggaataacacaagttaatttataatgtatagaataacagcggcatccactaaagatattatgctgacaagattacatttaaagtgttaatgtgagtggtcagaaagtgcatgctctcttctaaattcacatcaaaaggggagtcagaatcttcattacaattcaccctgattgagtgctgagagctttcaagccccacactctccttacccttctgccaacacttgaaagctggtaagaaacctaggtgctcccttcctcctttaggatgccagaaagttcaaatctttcaagaccccaccagtatgagacaacctgcacccaaaccccaccttttaatctcattaaaaatcaaagcagtctcctttccgtgttctttcaagccattgttggacctgactgggagtttctctgccctcctcataaaacctcattatgtgagtaataatactcgcttggcttagttgaaattcattgtgttgtatcctgcagtttattgtctgtttgcaaatgacaataatttgcaaaggaaactatttgcaagtgtggcatcatctgcaaaaattttgggtggggagtcccccagtatttttgaagtgaccacagcaggtagagtaattagagggggaagaaatgattttaaggagaaaagggtgaatctagttttggtggtaatggttctgaagcgatttgggtatgtataatcagttgtcacaaatacagtgggagattgggagtgatgtctgggcaggtggcagcttggattcatcagcatacaggtagaatcaagggcctggtgaagatgagattacccagggggtacacacagtgagaggaaaagagggccgggtccattgcatcagctgaaatctacctctatattattcactcctccctttttaatgtgggctttattcttgataattttttgttttttcttgtgcttgacttaacttcaacctaaattgaagtcacagattaatattaatctctatcttttaagtcaatccttaaaaatcctggcgtctacatcatacgcaggcaactaaatttaaaatttcagggctgtaacccacacattagtaactttaaaatttccttatgtgaatccaatgtgcatccaaggttcagaaaaaccactgtaggtgaattgaaattagtagaagtataggatatacttcttccgaagagagcatgcactttctgaccactcacatgaacactttaaatgtaatcttatcagcataatatctttagtgggtgcctctacaagcataggacatacttctactaggttttgatttttaaaattttaaatgtgtttcacatcttgttttggaatggatttaaggtattttatatggctaattaaattataattaattatatggctaactaaaatataattgctgccttatcaatgaattaacttttatcaaattcaaatagtaggtcttaatatgcccattttatagttaagaaaattgaggctgagagagatcaagtcactttccaaatatgcacaactagtgactgacagagaagtaatttaaaaccaagtttcactggttacttccataagttaattcacctaacagcatagctcaatgcttcacaggttaggaatctaggattttgaatatttttttttcataaagtacctggaactttccccatattcaatttaaccttctctcaaaatgcatgtaaagtaatattaaattacagcattgccaaataaggcatgatttaattcgcattttaaagaatttggaggtgtttgtgaaaaagtgacccatagcgtagaaatcttattataagggtaattttccttatttttaagtaaaagttcaaatttttctgccaaacggccttgggcatttaaatatctattagaatgtcttcccatattcatatcttctatttctgagaaacaatcatagctttagacaactttaggaataatttttgacctcttataacaacagagttgaccttctggttattctctcactagtaggaaatccccagagtttcttttttatgaaacagctaaaaaacatttagttcgactgccatcaaagtatcttctattccactgttgttactcaactccagtgcccttaaattctctaaatctgaggatcatgatttaagaagggaagatcaagctcttcctggaacgtttccagtggaggattagctatcacagtttagcataatgggatgattcatgtgttacattgagtttataactttgcatcttcataaaagttttacttagattataaaatctcttggaaaacaataaaagtgtaattctagaaaaatacacgaaccacatatttcaaataattggattttggtttaaaataatggtcaattggctatttctgattttaagaatgacttaaattggggggcatatatttctttagaccatagaataaatgtgctgtaaataatttttctctcataaaagggttctcagtccagagttgagtatcaaaggcaaaaatggtacactgaaagtgtttgaaattgttcaaattaagagaaaaatttcttcagcagaaaggtatgagagataaataaaaaataaaaaattgtaaaaaataaagagaaaacctttcttgtttttttccaaatgcgatttttccaaatttcttcagaatgtttcagaaatctttatctaccctcctctgagatagaaaagctaagaatattaagtagctagaagttaagaaattcagtactagaggttgtgctgagcgaagagtcgtgttgatgaattcggtgcttactactgcaaaatcctggatcgagggtgttatcttgatttgtctaaattgtgattccctctgtctgccactgattggtccaggagccttagggctgagccaattggtgcatagcgtcacctggacatgtgaattggtttaaatgcttcaaagagttcttggaagggaagaagcagtaatagttatagtttcttatatttttattttttttttttgagatggagtctcactctgttacccaggctggagtgcagtggcccaatctggatcactgcaacctccacctcccgggttcatgccattctcctgcctcagcgtcccgagtagctgggattacaggcatgcgccatcattcccagctaatttcctcatttttagtagagacggggtttcaccttgctggccaggctggtctcgaactcctgacctcatgatctgcccgcttcggcctctcaaagtgttggaattacaggcgtgagccaccgcacctggcctgcaatctttctttccatactttttttttatgtatagaaataagacctggaattttttttagctatcttctaccagcgtgttgatgttgtcaacacacagaaagagcagagaagaaaatctagagaaatggagttggaactttgactaaatcatgattgatcgttcccaatcagtgaacattttagttatattctctattagttcagacaatttaaattagatttttctgttacttgtgtccaaagcatgacttttggatataatgtcactgtgtttccacagcttagctgtataaaatatgagccaaaataccttccctgagcaatttgtagatttttttcttacattgactatggttgtaaagaatacaccttacaagttacctgatttttttcttcattaatgatagtatttttcttcatatttaaaaatacaataattttgccagtgcgtattgattgctccataacaattttccccaagaatatgtgtgtcctttcacatacagatttaattcatttaagtttagaaatttttcttctagaatacatataaatacatttcgtttcttttttctcaattatgtatactttagatcttcttttcctaatacagctatacatttttcaactcttttaaacttatgatgtaaagaaattagaaattaataacaaatgtagaaaacaacaacattgctacactgttacttcaaattttaaaaaatccttaaaacaatttttagaataaaaataaattcaaatgtaaaatatttagaaaataacaatagcaataacaatatatagtaacccatgggtagaagaagtatccaaaagtagaagaactcattcagaatcttaaatatacattaagaacaaaacaatacaaatgaataaaaatttaaaagagagatttagaaaagagaaaaaacccaacttaaacaattatgaaagactatattattaaaaataaaatataaatttataaataaaatcagaaaaaaactaataaaataaaattctacagactaataagcgaaatcagtagttggccttatcagcaagcactggataacagtactgccaaaagaaaaaaaaaaagagttggctctattagaaaagcaatgataatttaacataggagaggtcgacctaatcaagaaaaaagtagaaatactgtaacgaagaaataaagtacagagtaaagtcaattatgacatactactttatataattctatgaaaaaaatttgaaaaccttggtgaagctgaggaccaaataaaatataaataaccaaattgaaagtttaaatgtctcacattgctaaagacagtaccatgatgaattctgtcaaaccttcaaaagacaatgccaattttattttcataataccagatcatgaaatagaattcaatcttccaaattctttttacaaagtcaagccaccatttataatagaccttgtgaaagacaacacaagaaaataaaactttaaaccatcttgtatctgtcaagtttccatcaggagagaaagaccagtatgaattaaggggtaaaaaagttattataggaattagactttacacagtgttgggggaagctggatggaggggaactgaaagttgaactagggagttgggagatcagaggcatcaccaacctgttaatatgagtagcccagcacatttagttgctgaaagggaaccagaaagggtagactggagaagtctacagacagctgttctctctgagctcctgcagccaaatgtctggtgatgggcctgcagtgactgttggccagcagggccagcagtgaagatgaagacctccacgcagagcagaagagagtgaagacaagctggaactttccaggtaaccctgtgcctctcctttacctcatgtaaccatgatgatcttcaaacaataatggccattgcttcacttgcacctaccaaatatcacaaaaattcttcttttggccaattctaacaaagaacagtataaagaaggggatgctgaggaacattccttccaactaaatcaagttggcactcagcatagtctaactcttcagtatgacattagcatagagctttttcaatcatatttaacttccaaataaaggcagcaacaaaatcatgcttttgcctaatatgatgcaattatacctatacaacgaaacaacacaatagcattctctccagaaaagattgcacacaggttgggcgcagtggctcatgcctgtaatcccagcactttgggatgccgaggtgggcggatcacaagatcaggagtttgagactagcctgaccaacatggtgaaaccccgtctctactaaaaatacaacaattagccgggcgtggtggctggcgcacgcctgtaatcccagctactcagcaggctgaggcaggagaatcgcttgaacctgtgaggcagaggttacagtgagccgagatcgtgccactgcactccagcctgggcgacagagcgagactctgtctcaaaaaaaaaaaaaaaagaaagaaagaaaagaaaaaaaaaaagattgcacacagtcctatgtcgcattatccacctttgtgtgatacacatttctcttctagctgagtcatattcctctttgctatccggtaacatacatagtgagagagaagtttaaccactattaacatatcttatatagtagaagagggaaatgtgataaaattagagaaagaatcgataaatatattcactctttcatatacacacatatttaaaacacagtaagaaagaaatactcaactactacagcccttgtttccaactagtcagttggttgtaactgactattatgtttctttttccataccaactccatattccttttgccctagcgaacacctccggtggttaggttccttacctggtagggtgaaacatatcttcatttcttattcaccaatatggattgttatattttttcatggcccttaagacatggggactattaagtgagaacttaaaggatcttctaaatttctccctgatctcattgtatgatagaaaccagtttctccttcataatcagatttcgttacctctgccagtagtcgaacttcattttgtttgtttgttttttgttttgtttttgtttttgtttttgagacagagtcttgctctgtcacccaggctggagtgcagtggcacgatctcagctcactgcaagctccacctcctgggttcgcgccattctcctgcctcaccctcctgagtagctgggactacaggcgcccgccaccatgcccagctatttttttttttgtatttttaatagagacggggtttcactgtgttagccaggatggtctcaatctcctgaccttgtgatccgcccgcctcggcctcccaaaatgctgggattacaggcgtgagccaccgcccccggccaaacttctttgttattgattgagtggtgtgaggaccccaagtagccaggtggcaatttcagtttctacttaaatagaatcattgatgtacccattggtgaacacattccttctttgggaaccaagacctctatagaagcaaagcccaaaactgagggtaaaacaaacaaaatcttgttagtgaatcatacagataatgatgagaggagtcactctggcttctaccttttgattcttggacccataatcccaaaatagcaccagtatattgattgctgattcagagtatatatcatattctggtaaaagcatcccagatctgtaaagtattgttacccaactgaattttcaaaagtcctttctacgataatttttcacatttgcaaatacagaaaaccataaagatggcaattgacataatccttgtggaaggccatcaagtagtgataaccacaattacacttttggcatatgttcaggttatgtgtgtgcttacggaatgcggaagtatccagtctacgtatctctataaaaattgctttctatatgtatgtttatccatctgcacttttaccaatgacatattaaaatgttcattgcaagttatttttaccagaatggctctttgttggggaaaaggcgaagttcttaggcaaaaaattttgttttcatatgcatttttgattaggagaggtgaacaacttttcatgcttttaaactagttataattacttgtcaattatcagcttccctttttctcgtttattaggatcctgtatttactagtccttcatatgacctctataaataaatatagtgagagtctaggtgttcccgttttttacattattatgggggtgcataatgtagaatatgtttttacatttaatgtaccatagcttttttatttctttataacttgtaaatctaaaaagtcattttatccttcagaggattgatattcaattttatgttgcctaaatttttatggtttttctatatttaatacttgaatctatatgttatgcaaatttttaaactacatataataaagatgttgtctcctttcaatgtttgtgcctatttttttattccatgacttggtatattttctggaagtgtgtgtgtttgtgtatttgtgtgatcatgtggcattaaccaaaattctttattttaaaatatttgtttatttatttattttgagatggagtgtcactctgtcgcctgggctggagtgcagtggtgtgatctcggctcactgcaacctccgcctcccaggttcaagcaattctcctgccttagcctcccgagtagctgggattacaggcacttgccaccacgcccggctaagtattgtatttttagtagaggtggggtttcattatgttggccatgctggtctcaaactcctgacctaatgatccacctgccttggcctcccaaagtgctaggattgcagacataagccaccatgtgtgcccagaaattctaaacaaatattaaataatataggtgatacaaaatgagttttgttattattttagtagcaaatattttatttgtttcagccaatgtattggctagacaattatgttagatgatttttttatattttatgttttctactccagatttgtcttgttagggagcaattttatccaaaatgtgcgatttcaaatgttatttcatgtggattctctatgattttgatatgatcttagagtattataaacaatattataaaacagtattataaataatattattatattataaaataaattttggctgccattgaaatcattttatcttttaaaaatattaaatttaatttcatacagtatgcttatttttactttaaaaacagtgacatattactaagaaaatgagactaattgcacattagtatctcaagaatcaataatataacaatgtctacagcaactaggatgcaaaattaatgtatttatctttatcttttactttccattgttaaaacagcatttagaagtgaacagtatttctcaggaatatccaatgtcttagttccagttactctaacaaagtgccataaactgggtggctgataatgaaatttgtttctcaccatttggaagctggagtttgaaagcagggtgtcagtaaggtcagcttctggtgagggctgtcttctgggttgcaggctgcaggcttctgattctatggagaaccaggttccagggcagaaagacattgaactagctcttgggcctcttctaatcgtgacgctaattccattcataagggctctaccctcatgaactgattacctcctacaggcccacctccaaacaccatcacattgaaattagagtttcaacatatgaagattggaaggacagaaatattcactccatggcgtgtcaacaaaaataagtgtgtctttgcatataatttgtggaggttttttttttattatactttaagttccagggtacacgtgcacaatgtgcaggggtttttttgtttgtttgtttgttttatttatttatttattttttaattttttttattattattatactttaagttttagggtacatgtgcgcaatgtgcaggttagttacatatgtatacatgtgccatgctggtgcgctgcacccactaactcgtcatctagcattaggtatatctcccaatgctatccctccccccttcccccaccccacaacagtccccagagtgtgatgttccccttcctgtgtccatgtgttctcattgttcaattcccacctatgagtgagaatatgcggtgtttggttttttgttcttgcaatagtttactgagaatgatgatttccaatttcatccatgtccctacaaaggacatgaactcatcattttttatggctgcatagtattccatggtgtatatgtgccacattttcttaatccagtctatcattgttggacatttgggttgcttccaagtctttgctattgtgaatagtgccgcaataaacatacgtgtgcatgtgtctttatagcagcatgatttatagtcctttgggtatatacccagtaatgggatggctgggtcaaatggtatttctagttctagatccctgagaaatcgccacactgacttccacaatggttgaactagtttacagtcccaccaacagtgtaaaagtattcctatttctccacatcctctccagcacctgttgtttcctgactttttaatgattgccattctaactggtgtgaaatggtatctcactgtggttttgatttgcatttccctgatggccagtgatggtgagcattttttcaggtgttttttggctgcataaatgtcttcttttgagaagtgtctgttcatgtcctttgcccactttttgatggggttgtttgatttttttcttgtaaatttaagttttttgtagattctggatattagccctttgtcagatgagtagattgcaaaaattttctcccattctgtaggttgcttgttcactctgatggtagtttcttttgctgtgcagaaactctttagtttaattagatcctatttgtctatttgggctttttttgccattgcttttcgtgttttagtcatgaagtccttgcccatgcctatgtcctgaatggtattgcctaggttttcttctagggtttttatggttttaggtctaccatttaagtccttaatccatcttgaattgatttttgtataaggtgtaaggaagggatccagtttcagctttctacatatggctagccagttttcccagcaccatttattaaatagggaatcctttccccatttcttgtttttgtcaggtttgtcaaagatcagatggttgtagatgtgtggtgttatttctgaggtctccgttctgttccattggtctatatctctgttttggtaccagtaccatgctgttttggttactgtagccttgtagtatagtttgaagtcaggtagcatgatgcatccagctttgttcttttgacttaggattgtcttggcaatgcaggctcttttttggtcccatatgaactttaaagtagttttttccaattctgtgaagaaagtcattggtagcttgatgaggatggcattgaatctataaattaccttgggcagtatggccattttcatgatattgattcttcctatccatgagcatggaatgttcttccatttgtttgtgtcctcttttattttgttgagcagtggtttgtagttctccttgaagtggtccttcacatcctttgtaagttggattcctaggtattttattctctttgaagcaattgtgaatgagagttcactcatgatttggctctctgtttgtctgttattagtgtataagaatgcttgtgatttttgcacgttggttttgtatccagagactttgctgaagttgcttatcagcttaaggatattttgggctcagacaatggggctttctaaatatacaatcatgtcatctgcaaacagggacaatttgacttcctcttttcctaattgaatgccctttatttctttctcttgcctgattgccctggccagaacttccaatactatgttgaataggaatggtgagagagggcatccctgtcttttttttcaaaaggaatgcttccagtttttgcccattcagtatgatattggctgtgggtttgtcataaatagctcttattattttgagatacattccatcaatacatagtttattgagagtttttagcatgaagggctgttgaattttgttggaggccttttctgcatatattgagataatcatgtggttttttgtctttggttctgtttatgtgatggatattgtttactgatttgcgtatgttgaaccagccttgcatcccagggatgacgccaacttgatcttggcggataagattttgatgtgctgctggattcattttgccagtattttattgaggatgttcacatcaatgttcatcagggatatcggtctaaaattctctttttttgttgttgtgtcagtaccaggctttggtatcaggatgatgctggcctcttaaaatgagttagggaggattccctctttttctattgattggaatagtttcagaaggaatggtaccagctcctctttgtacctctgtttgaattcggctgtgaatccgtccagtcctggactttttttggttggtaattattgcctcaatttcagagcctattattggtctattcagggattcaacttcttcctggtttagtattgggatggtgtatgtgtccaggaatttatccttttcttctagattttctagtttatttgcatagaggtgtttatagtattctctgatggtagtttgtattcctgtggtatcggtggtgatatcccctttatcattttgtattgcatctatttgattcttctctctcttcttctttattattcttgctagtggtctgtcaattttgctgatctcttcaaaaaatcagctcctggattcattgattttttgaagggttttttgtgtctctatctccttcagttctgctctctgatcttcattatttcttgtcttctgctagcttttgcatttatttgctcttgagatatttataagagtataaagcttcatcaaaaccaagtaaatatattacagatatgaaatatacatatatgaaaatagagaatattaaaaggcatagtttactgaagatttattcaacattttaaaaatcttggaaaggccactaaaatctaaaaaggatatgtacatatataatgatgcaaagttgtctcatactacataaagctttgtgccaaatctatgaaaattcaagggattaaacaaaattaatcagaggcttataaaattatctaaatcatctccccttatggtgcataaagtttacaatataaaaatattctctagctggagacagtttcataagtatttgttggaacaacctgtgtcaaacaatttttcttttaccaattcatttattttctttgtgatcataagccttctgaaccatgagaacattctggaaccataagtatatggtctccaaacaccttcacggtagaaacttccatcctgtgaacttgctctgagggttgcatacctgccaaatctcctataattacagaagggcttccataggaggtaagttcaagcactgctgtagtgttttattttggtgatgtttccttacagatttctacaatttacttttgtttgtgtagttttcttcctattctactttccagtaatatgattttttaaactctacatttgacttattgaagtataattaaggttgtaatacgtcactatgtaaataaattctaaaacaaatgttgagtagactttatgaaagtaaagggaatccatacttgtgcttttaatttccatacctacactgacctctttcttttcaaccgtctttgttaatctacctagcgtttaaccttttagacacatctctttttggaatgtataagtcttaattttctctttcttctctctctgtctcttgctgtcttttcttctctattttgcataaagattggtaaatttatttgaaccttttctaagacatatccctttgtgtgtaactggttccaaagctcattgcaatgatttttctgttgtgagttctaatatttgattcttcagtatgattttgtacatcttttcaagcagttttagtttcagaaagcatatttttgtagtattttccccaaaaccttacatatatgagaatatctttttctttacataggtatatgaatttaactagggtacgatttcttagtttccccttttttcaactcactgttttgtgagatttgctggtttgtaggaggaaaattgtaaaaaaaaaatcttaattttgatctttgcagataacttctttgtatatgcatacagaagttttgtttgaaatttaaataattgttgaagttatgtctctgggtcatcttaatgaattctgacagcaatctaatgaaacgaaatcttcatgccaaaactaacacttgtcagttggacctctctatagtctgtaacgtattttatttcctctccctttagtgaagttcatctgacatttttctcaagttagtcctctacttcctgaatttgattttctgccagcatactgctcttctctctgacctggatggcttttccagcacagtgttagatagttatgctgcggttccatttttgccagcagactaaccccagactctaaatcccagtagcaatgtcttcagcttgtgggtggtactggcttcttgctgttagtattctgtgggttgcctcgtaagtctttttttttttttttttttttttgacttcatggtatgtttatcacctgtgtgtaaataattatagaaatctcttccgttttaaatatttcataaggtttctgttttcctggttggaccctgactaatacaacttcccagtgcttactattcatattttggtctgtagacaataacttttattttgccaaaataggatcgtctgttcataaagttctacaacatgctttatttctgtgacattgtttattctaccttcatcttaatggcagaataacatttcttcatgctggtatatcttaatttacttaatgaattgattcttggtgggcatttatatggtttctaaatgttctattattataaaccttccttcttcctttacatgtatctttcagcattttttcacctgtgatttcctacattggaaactttgtggaattaaaattgggtaaaaatatgattttttattttaaataatgcataatcctaaatttccagcaaaaattataccaatgtattatatcccccaaagtgtctgacaaatagatggaaaatacctcattttcattttaatttattttttattatattatcagtgagactaaagttgcgttcaaatgcttagtggccagttgtttcttatcctgagaattgcctatttgtgcgctttctctacccttttaatgaggttttctggcttttatttttgatttataaataatctttacatatgataaatattagctctttgctatatatattttaaccacttgtgtttattttgtgtgtctcatgggtccaatataattttgaagtcaggctttctttcttttttttttttgagatggagtctcgttctgttgcccgggctggagcgcagtggcgcgatctcggctcactgcaacctccgccattctcctgcctcagcctcctgagtagctgggactacaggtgcccaccaccacacctggctaattttttgtatttttagtagagacggggtttcaccgtgttagcctggatggtctcaatctcctgacctcgtgatccacccgcctcggccgcccaaagtgctgggattgcaggcgtgagccaccgcgcccagccaggttttctaatttctatgtattcccttctttcccttgtccaaacttgtgaagctgatagcttctgtgttttcacagtcttctatttcagagcccttgggacattattgtttgatattttgtttggccatctttgaaggaagggaggcacacgtatgtccagtgctggagatcagaaaggagagaacttatgctttccaagtgtagctagaagctagcggagtcatctccagttctgattaatagctggaggaaagataaaggcagacaaattttacctgggtttataatattcaggaggcagtcactaaatgcttttctgcttgcagctatgagtgtgcataagtgtgtgtgtgtgtgtgtgtgtatgtgtaaaggagggagaacctcttgtaaaagaattacagttcaaagaacaagaagcttgggggaagaagttccaaacttacattgctttggattccatgcacagtagtggacataatctaagaacacaggttgacacactcagacaggatcagtaaacaagtcttttttctgggctacttttcctacctcctaacctggcctgatttggcccttgaattgggtctttcctctctcgacacattggctgttcttgctggtagaactccctgaaccagagccagcattgcctgtcctgcagtgatgctggtaccttcttggttttttttgcttttgtttttatggcactagaacaggttaaagaagaatccatagaaaaagaaatgcccgatacacctctaattcttttctcttggtgtcctggtttggtatctatcagtagcagtcactggtggagtccttcccttctttacttcttagtcatgctgctttgtttcaggaaatacaagacactaatattactagtgctgtaatcaatgggaaagtctcccagattcttgcatacacgtttttttttcttatattacttctttcccttttaaaaatagtgacttaaatgacactacatcgcagacactacatgacaggggtacaaacaagtccctgggtcacttaacagaagtctcaaaatgggttgaaaacacccaaaaaaagccaagaaacccaggcagaactttagtgttttttggtttgtttgtttgcttttgtttttattttttgtcttttttgaggcgcagtcttgctctgttgctcaggctggagtgcaatggtgtgatcttggctcactgcaacctctgcctcccgggttcaagcaattgtcctgcctcagcctcccaagtagctgaattacaggtgccggccaacatgcccgactaagttttgtatttttagtagagacatgtttcaccatgttggccaggatggtcttgaactcctgacctcaggtgatctgcctgcctcggcctcccaaagcgttgaaattacaggcatgggccaccacacccagcctagattttcatattaacaaaattagaaaaatattttcagcattagagtttacattcatctcactgtgtttctgcctggattcccttttattgaactaaatcaccctctattgactcagtacgtaaatcctttaaagacttttgacaattatgttctcctagaagtctttagccaaggactgcatactttatttctttcctctcactatataaatcaatccctccagactcttaattgtatttgctgttcttttttgaactccttccagttcctcagagtttgtaaatagaaaaagagaaaaagagctctatctcaaagtgatttccagttcaggtacactttcttgcttcgtaatatgatgggccacccagatgatttttagtttttccccctgaatcctcataacatttcagtttcatctaatttactgtgatttgagtgctttccaattgtttctcttccattgaatgtctgtttctgattatttttctacagagatgttccttcacattatttcaagttgaatctcattttcttattttttcaccatgcttcaaacttctttaggctttttttttttctaattttccatctgtctgggtgctcagtgtccctctatattgagaaacctttgcacattttatcaaagcttcattaattcctgatattctatgaagatatttttaaaagaccaaacatgaggcaagttatcatgtgcagtcattctcagttagcatcctcttctcctgatgtgttgtttgccagcattcaatcactctacaatttcaagtcattctaaaacaataacaaacatgagactattaagttctcaccctcctcctttttctcctctttaatttttaatgtagtcctttagcccctaggatttctttctatctgtgaatcttggggcttatccaaataaagttgggtccatgatgatttgttaataaatatcgctaagcttctgattacatttctgaatattcagccatgctccactggagcctgcagggatttcggccatactgaaatagaaaacattccttagagagccaaggtgttcagtgagaaatgtcaaagcttctataccaatgattttcccatgatccacactctcattttgtaaattaatctgagagcactaagatttttttttcccacagaaaccagggaactccccttttgtagagaaaataagacgtagacatataaagaataccttcatatataaacggtatcatagttctggacagaatctcaaatggtatgcagaccagctcactatcttcagatagaaacttacctttttgattcaatcatgtgaatattattttcaaaacttaccatcacaaagtactgtgcctcttgagagttaaaaaaaaaaagatcctgtcctctaggaacttacagtccatcctgactaaccaaaataccccacagtcccgaggaaagagtaaatgaaagccaagatgacctcgctcagaggtacagagggcaaggcagcagaaaggagatcactattctgagtgctcttgcatctcgttgtttgtcacaaaacactttcctcacttgaatgtaagacatgaaaaatgttctgcattcaccatgcatgagggtgtttttgtcgctatgatatgggaaaggataaaagagttcagtagttcttgagtttgtgtgtgattgactcttaagactcataaaatagcctctttcatcagaaaaatggtgatatacaaatttctaaaatattgcatgcaattttaggaaaccattgtgtgctgtttttctatttctgccataagaaatgaccacacacttagtggcttacaacaacacaaatttatgatgttacagttctgcggggagaagaggaaaggtctcaccagacataaacctcagtgggagcagggctgtgttccctgctataggcccttggggagaatccatctccttgctcattcaggtgttagcaaaatccatgcagtggtaggactgagtctgtgcccttgctggctgtcagatggaccactctcagctcccacaggcatctttttggtccatgcacatagtttcctttacatccccaaaccagcaacaaggcctcaaacctttctcatgctccctctttctgacacacttacctgcttttctgtcatgctctcaacagcacatgtgatgagactggacccatttgaataatccaggatagtctcaccagtgtaatgtctctatgcttaatcacatctacaaagtccattttgcctcacataacatcacatagtcacaggttcccaggattggggcatgcacatcttttttggggggaagatcatgctacctccattatttatttatttatttacttatttacttatttatttatttgagatgggagtctcactctgtcgcccaggctggagtgcaatggcacaatcttggctcactgcaacctccgcctcccagattcaagctattcccttgcctcagccttccgagtagctgagactacaggcgccaccaccacgcctggctaatttttgtatttttagtaaagacaggatttcaacatgttggccaggctggtcttgaactcctgtcctcaagtgatccacctgcctctgcctcccaaattgctgcgattacaggcatgagccatcgtgcctgtacctacttccatcttattgatctagaacctagttataggtcctcaagaagtgcatgaaatttatgttaaaatcccttgattatttttttcccacctccactttttgttcatcccaaagaattccctgattaccaacatgtacagcatttttttcatttttcttaaaagaaaatttctacactttattcgccaattacataattcagtcatgacattaaaaccacatgaaatcttattctatttttaaaaagtaattttaatatgtgtcacacaacattctgctactgccatattggtgccaccgacaatttgtcatagggaacaaataaactgcagcttcatctgtcaaaacattaactggtaattaaatggctgctgtctctgtacaatccctgacctgtatcctatcccagacttatttctccttaagagtctcactgcttcttattgtgtagacaggcttcagcttcagatcctcctttccaaacttgccccatccttgaccagaatctccccatcactgccctggctccgttccaaatcctcattccacccctgacccattgtgtaagggtctttggcttgaggaaatgtaaaaacacttaaaataccaagcaatattcacatttttttgtctttgcaaaaatagtcctagaaaactgtaattaatttaaatgagtttgaagagtatatgtggagtaacaagcacacatcattataaacattttttgtttagtttataagaggactgtgattgtctgacagagctgcttagataaagcggttcttcattgtttgcaaatgaaatttagagtggattatctaaacatttagaaatccactgttggtattcactgggtaaaattcgatagagattagaattttaaatgtaagtaagtgaggaaaagccataatggaggttaaagaggtgataatttagtgaaaaatttcaaagactgtcaaaaaaattaaaagaaaataacaccatccttgaataaacaagaagaatatttcataattgttgcacaattaaattagaaatatagtttatttcttctgatatccttaataaatgttatttacttttaaaaaataaaatatctcctgaagaacaaagagtagatttgcatttagtttattgatgtccattttattctagtcaaatgctatttctataaatctcagttcaacaacagcaacaaaaagagtgaggaaaaaaacgaagcttggatacagtgagaggaagggaggaatccgatatgtgagaaaggtaaagaatgttttatgtaaacattatatggtaataaagaaaagtagttttgcacatatttgactctgttgtgcctgattgacaatggtaacatcaaaacaattggtgacatcaaagtgtactggttaatttaaaatcctactttttcccatttatttttccatttttgggaagaacacaaagtaaaatttttatttggacactcaggatgggctgcatacagagtctcttttctctcagctttggcggcaatactggtgtctctgcctctccctaataatgcctgaagtatttctttaaaatgtggtcttaattcagacaaaaatgttttctctgaaagtgaaagtgcccactgtattaaataaacaaaaaatacagtttaccaactagatacatagcatctatctctatatgtgtgtgtatatatatatgtataatttattttgtatctatgccataagctgtgaaattaattaccatcacattttattaagattttaggaataatcttaatgattcaaattgtgtctttgtctcattttagggtttttttttaatctgctgattctacagtgaagcatcagctggtttctggttatcaaaactaatatattaaatgcagacatttcataatctgcctataaactataataaactgcaattcccggtattagggggttttacatgtggttattttttaaagtttttttggaatacttattcagtccttacagtctactttaacttttaaatattacttttactttaaaaagcaaaataatataaagcataaaagtatgaaactcttaaaaatacaaagaaaaacatcctctattgctaccatccaggacacaaaggtctttctctccctctctttctctctttgtctatttctctctctcattcttttctcttctctttctttctctctttccttcctttcttttctgttcttttcctttcttttcttttctttcacagggtttcactgtgttaccaagtttggagtgcaatggcaccatcatagctcacagaaactttaaactcctgggctccagcgatcctcctgcctcagcctccaaagtagcttggagtacagttgcatgacaccacacctcaataatttttgaattttttgtagagttgaggtctcactatgttgacaaggctggttttgaactcctggcctcaagtgatcctctcaccttggcctcccaaagcactgggattacaggtgtgagccactgaatccagctatatgcactttctatgcttactatatccaatattgcaacaaaattagaggagattttaacattacaataataaatgatcactggaagttcttaaaactttagaaatcttgaatttctttttttaaatggtgatgccccaacatagaacatctgctttttaaaggcataaagtaacaatctctgcccttcttagttgtaattcatttaattttcctgacatcctctttctttaaaatagccccttttttgtcccctttagtggcaacaatggttatttttgtttcctttaccctcaacaaggttattacttcatatgagctggggtaactgtaactctaaagtgtaatgtatgttataccagtacttacatttggcaaaatagaatccttaggaacataattcactctcaattaaactttcaacatataccacgaaactaagaagtcaaataaaattacgcatcttagcacctgcttagatgtttgctagaaaaatttagtttagatttgggagacaggtaaagtcagtcttgtctttaataatgaaatactcaatttgaaactggagatttagctcctggtatttgcagcttactatatggtaactggcatacggattctttctctaaagaacaggattaggccgggcgcggtggctcacgcctgtaatcccagcactttgggaggccgaggcgggcggatcacgaggtcaggagatcgagaccatcccggctaaaacggtgaaaccccgtctctactaaaaatacaaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaaagaacaggattaacagtgaaggtctctgataattttgtggatagcaagtctcctcttattgtcatcatgttactaaagtaaccaagaaggatcagcgaacatagtcttcctaagggtagaaaaggagttctatttttttatcaaaagaaacttggtacatctttaatgattgaaatatttattgattccaagaaactataaatgctcatttaaagctcaccgcaaatagttatttctaccccacatgtgctctcttgtgtgtataagtagtcacacacacaggcacgcagacacactcatggattttaactattagaatacaatgcctacaggactttctggtcagaccaaagtatgaaatgataaggatgtttctgaaaatttgaaattttactattatagtggagtttttgtctcttcaagagttttttgatttccctagtgtggtagcctgaataatgcctccccaaagatatccacattgtaatccccagaacctgtgaatatgtcatcttatatggcaaaaaagaaattgaaaatgtaagttaaggatcttgaaatcaagagattatctgagattttccaggtgggcccaatatcatcataagggttcttacaagaaacaggctggagggtcagagtcagagcaggtgacgtgatgacagaagctgagggagagaaggacatgtggcaacgctggcagatgtgaaagtgttgcaggaacatgagccacgtaactcagccgcaacagcagctgggaaggctcaggaacatctcctcctgtagagcatctggaaggaacccagccctgcccacagcttcattttagcccagtggaactcatttcagacttctgatcttcagaactatgaaacatttgcattgttttaagccattatatttgtggtcatttgttcgggcaaccaaaggaaactaacacagctagcatttgcattttctactttaactcttcagttttatcagatgatgtcctcagtgaatcattgtcttccataaacgtattactccacagggagcctcaaacaagcacatacatacgcttattttggataccttgtctgttctaggagactctatacatccatttgtcttcgtggagtacatgcaattaattggccttatcttagctgtcaataaaccaaagagccactttttaccttgacactaagtgaaactggtgagtaccatccaaaaggtgatggcttttgctaggagacatgtgtctacctcagtaacacttggacactttagcaaacattaataatctttagtcactttagcaaattgtattttaacagaagtatgtatattcaaatatatgtgtatataaaagcttatatatatttaatgttatagtaattttggctttttatttctatattttaatcgttatacagaagtctgtataaatagtcttcaaattactacagaaaatattttgttaaattgaaaaattaacaattaatttatcatctattatactatgtgtaaactgctgtcctctacagggcagcagagaatatagtatcaattatggttactgtctcaaataattaaacaaatgttggtaaatctagaggacacagtcctaaaggccataagtaaaaatgtgatgcagtcgttttggaaaaattattaaaaactctctggtaaatatgatattaggctaggaatacctgatcttttgtttgcaatgttacaaggaaatgtgtctgaataatgacaaacggataaaagctaaaaatactagtaagaaactttatattttaatctttattgactggactcttgataaaactgcatgctttgagagtagtatttttagaataaccacttttcattctccaccctctcaaattgaacgttacagggtgcccccaagaaggtgggacaaattttaactcactcttcgtgtgcccctacttttgtgaaacagggacagcgcttgccaaaaaagcaggcagctgcctttgattcgaacaagaacagaatgaaattaatccttcaccctttgtcaaagaatgcgtgtgtgcttacgtaaacttctaaatccattcagagttaaatctcagtacctggcataaatggaaggaaaagaggatgggcggaattacatggcacatttatatttcagtcaattaatgaaaagtgttagacaaagtgttgacagaagcagcaaggctgtagaagcagggcatggtctggatctgtcctttctggtattgtactgtgtatggaaaatgtggtgccttgattggaggagctacctgaaaacctggttatttgtctgtagtccagcagcctttcacagatgaatgactgcatggagttaaaagctaatctacaatgtcattttgacccgaagttcaaataacattttagaaaacatttgagccttaaaaaaaaaaaaagatgcaaggttacatatgttctaaaatacaggagcaaggtatcataattagaaatatccatcctggaataaaggctggacaactaaaacaaaaagcaatcaagaaagagtaaaatacaacaacaatcaacattcatattgcaggaaattaaagagtaaaagctccactagagaaaacttaaagaaatagattatgaacaacaagtgcaaacataaacaagtaagattacatcaaactaaaaagcttctgcacagcaaaagaaacaatcaacaaaataaaagcaacctatgaaatgcgagaaaatatttgcaaactatatatttgacaaggggttcatttccaaactgcatgagaaattcccataactcaacagcaaaaatcaaataacttgattaaaaaatgagcaaagaacctaaataaacatttctcaaaagattgcatacaaatgaccaacagataaatgaaaagatgatcaatatcactaattatcaagtaaatgtaaataaaaccacagtgagatatcacctcacacctgttaggacagcgattatcaataacaaacacaaaagagataacaagtgttggcgaggatatggagaaatggaaaccttagtacactattcatgtaaaaatgttgcaggactttctactcagttcagctataaaccaggttcttgtcacacaacaaggaaagattaggcttgtggacacacagaagggtgagaataacaacacttactgggtgaaaaggaaaaagactctcagcaaagtgagagggattcctgttaacaagcccccatctcacagattgagtcccaggttaccacccaggaacaggagagaccaggctcccccccctgcaaatggtgcaaacttcccacagcttcaccccaacctcccagtgcacaggccaagtcagagattctccagggagcacttttcacttggctgtctcaaaatgatgcagcctctatggaaaacaatatggagagtcctcaaaaattaaaaacagaactatcagacgacccagtaattccacttctaggtatatatctaaaagaattgaaattaggatctcaaagagatacagtacttcttctatgtccattgaagcattattcacaacagctgagatatagtgacaacctaaatgcccactgatggctgaatagataaagaaaatgtgatgtatacatacaatggaatattactgtatctcagataaagaaaatcctgccatttgtaataacatggatgaacctggaagacattatgctaagtgaaataagccaggcacagaaggacagatactgcatgattccacttcagtgaggtatctaatgaactatctaatatagataaactcatagtcgaatggagttcaacattcccctgagtccctggggcctgcccacgccagcctgtggccctgttttcgcttgtgggggccttccgccacagacatttgaatggagtcaaatgggagttggcagcggctagaggaagggagaaatgaggagttgttgttcaactgatatagtttcaattatgtcagatgagtaagttctagagatcaacgttggcaatagtgtactgcacacttaatcatctgttcagggtagatatcatgttaattgttcttagcataatttttaaaataccaaccaaccagataaacaaacaaacaaaacccacaatagattataatagaataaaccatagaaataccatccagcataaaaatacaggctaaagaggctgaaacattgagatagaagataaaattcctagaacaaagagaataaatattaaatctaagaaggataggttctgtcaaggatggaatcagaacacaagaagaaggaatacaccaataagacacacttccaaacctagattgtcttcatcctgccctcattcaccacgatgtacacctctaccatgaatgtttttagctgtaaatagggctccttgcatgttcctacaatttgccactgacatagccatttcctgaaccaagagaaaatgaaagaaacacaatatttttcactccaggtgaacatattttctttcctcttagtctgtcagctctctttggtaggcgtgtcatatcctcatgctgaccccctatcctgtgctggaatttcttctacaataagagtcacttatattttgtgctgctgtgtgtggtattttcttgtcatactgcatccatccccagtaaagcaccattgctaaagctgccaacctgtttcatggctacttaaacatgtgttacatattaaaataacgtctgcaaacaattgctttctaaccaatatattgtggagtaacatttttactggtaatcttgtttgtaaattcttattactaaatggaaattttttaaaaaggaggccaattatgtgattcaggaatcctaataggagttcctgaattctagcattgcccttatactaagcaacatttgtatttgaatttgaatgccagaatactcactctggtattctactttcattgttttcagcatttgtattatattcattcacatagttttaaaaagcaaaaaaagcaagtaagtgctctcagataaatagtttgtcacttttatcatttggacgataacatgtttacagtggtaatcgcagtcaaccttgtcactacacattagtctgaaggatgtgtttactcggtttcccatagcaaaaaacaaaaacaaaaacaaaaaaaccacactccactgtactgattaatttaaatttctgaaacatgtttcacatttcaatgttctaaatacaaggctactcttgtcttatggtattttttggttattgttgatgataaatcagttttttttattttttgtaggaatatagtaggtatatatgtttatggggtacatgagctattttgatacaggcctgcaatgtgtaatagtcatatcagggtaaatggggtattcatcacctcaagcatttatcctttctttatattacaaacaatccaattatatatacttctttatttttaaatgtataataaattattgttaactgtagccaccctgttgtgctatcagatactagatcatattcattctatctaactatatttttgtaaccattaaacatccctacttcttctaccactccccactacccttcccagactctggtaaccatcattttgctttctatctttatgagttcaattgttatagcttttagctctcacaaataaaagagaacatgctaaatttgtctttccatacctggcttatttcacttaatataatgtcctctaattccatccatgttgttgcaaatgacaggatctcattcttttttatggttaaatagtactctgttgtctattaaatattaataccacattttctttatccattggtctgttgatggacacttaggttgcttccaaatattggctattatgaatactgctgcactattagtattactccattctcacactgttatgaagaaatacccaagactgggtaatttatgaaagaaagaggtttaattgactcacagttccacatcgctggggaggcctcaagaaacttacagtcatgatggaaggcaaaggagaagcaggcaccttgttcacagggcagcaggactaagtgaatgccagcaggagaaatgccagatgtttataaaaccatcagatctcatgagatttactcagaagaacagcatgaggaaaactgcccccgtgatccaattacctccacttggtcctgcccttgatatatggggattatggggattataatacaagatgagatttttggtgaggacacagccaaaccatatcattccatccctgctctcacccaaatctcacatcctcacattttaaaacccaatcatgcctttccaacagtcccccaaagtcttaactcattccagcattaacccaaaagtccaagtccaaagtctcatctgagacaaggcaatcccttctgcctaagagcctgtaaaatcaaaagcaagttagttacttcctggatacaatgggggtacaggcattgggtaaatatacccgttccaaatgggaaaaattgtccaaaacaaaggggctgcagaccccatgcaagttcaaaatctaatagttaaaatctaagagtttagattttaaacctaaaagttccaaaatgatctcctttggttccatgtcttgcatccaggtcacactgatgcaagaggtgagcccccaagaccttgcacagctccacctctgtggctttgcagggtatagcccctatcctggctgctttcatgggctggcattgagtgtctgtggcttttccaggtgcatggtgcaaactgctggtggttctaccattctgggttctggaggatagtggccctcttctcacagctccactaggcagtggcccagtggagactctttctgggggctccaaccccacattttctttctacactgccctagcagagtgtctccatgagggctccacccctgtagcaaacttctgcctggacatccaggagtttccatacatcctctgaaatctaggcagaggttcccaaagctcagttcttgacttctgtgcacccgcaggctcaacaccacatggaagctgtcaaggcttggagcttgcaccctctgaaacaactgcatgagctgtatcttgaccccttttagccatgactacagctgaagcagctgggacacagggtctatgtcttcaggctgcacagagcagggggccctgggagctgcccataaaaccatttttcccttctaggcctataatgggaggggctgtcttgaaggtctctgaaatgccctgttgacattttccccattgtcttgatgcttaacattcggctccttgttaattatgcaaatttctgcagtctgtatggattcctccccagaaaatgagtttttcttttctatcgcattgtcaggctacaaattttccaaacttttatgctctgcttcctcctgaacactttgctgcttagaaatttcttctacaagataccctaaatcatctccctcaagttcaaagctccacagatctccagggcaggggcaaaatgctgccagtctctttgctaaaatatagcaagagtcacctttactccagttcccaacaagttcctcatctccatctgagaccccctcagactggactttattgtccatatcactatcagcgttttggttaaaaccattcaacaagtctctaggaagttcaaaactttccctcattttcttgtcttcttctgagccctccaaatggttccaacctctgcctgttaccctgttccaaagtcacttccacatttttgggtattcttatagcagtgcccactacctcattactaatttattgtattagtctgttctcacactgctatgaagaaatatccaagaccgggtaatttataaaagaaagagatttaattgactcacagttccacatggctggggaagcctcaggaaacttacaatcatggctgaaggcaaaggagaagcaagcaccttcttcacagggcagcaggacagagtgaataccaggaagggaaatgccagatgtttataaaactatcagatctcataagactcactcactatcacaagaagagcatgggggaaaccacccccatgatccaattacctccacctggtccaccctttgacatgtggggattatggggattataatttaagatgagatttttggtggggacatagccaaaccatatcacatgggagtgcaaatatcttcttatgctatttcttattatttaaatctaagaaaatcaatgaaattatttaatgaacattgaattatatacactacttgtaaaataatgatatttgtttagcatatttaaaataagattgcttaaaatatgatacctgagcatatgtgtctatagtttcttcatgagattcagaagtagatttaaattgatatctacaatatcccaaattcgagtacaatgctagcttttttttaaaggataaacaattgttttattcattggtgtttccaaaatttaagtgaaaaaaattaacttcagcaatgaataactagtttggctattatgtattcagagctaggacatctaagcataacctaggattcattccttaaacgatattccctccctggcctttctgtttagctatgagtttcacatatatttcaagggtcactggaataaaacaataatatgtattagtaacgttccatcagtatttctctaaatatggtttaattttctcatgactttctgccttttggtgatttctagccctccggcaatagtctcagcatacttatagtaaaataacatgaaacagagacaaagaatgattatacaatgcccaagttacagtaatgttggaagaatagttggagttatgtggggaaataatattacagctactttttaaagttctgacaaatacacaattaactcttgtcactaaagtctttctcatccctggttttaactgaacattccccacccacagctggccgccctctggagagtgttagccacacctttgaaataaatagccccaaataccaattgttactgctgatggcactaaagcctacagcaaaaaccagacttccctttacagcttgactatcaagtaaaagaaaccactctagtttcatgaggtttctaagggtttagaatacttgcaatcctgctctttgcagacacatctgaagtgtatttctaaagttaaacctgtctttttaacaattagaaagtagagtttttactggaagcctgtagcaccaagtctgctttttgtatgaaaaagcacaaacaatgttttcatgtggaaacgaaggcatggatagccagttttaaaataaccttagctagattcatttcacagtgagttagagcagtttccaatgcatctgaggtttcagagagtgacttctttttgctttcagtaagctaaccttcattcaaagaacagctcaattgtttctgtatttacagtctcatgtgcggagacattgtcttcaacctttaacttctatagacatcagctcttacacagtgaagaaacaatacaaggacagcttcctgctcacatcagcaaacaaaacaatttgggataaaagtgtctgaatacacattactcaaaaacactatttttccatttcttttcttatgtaaatagaatcgagaaatcaaaactatgagcctagattgaatttgatggataacctctttaaacctccaatttgcttttccagacattctcatctcatcttcctattaaaatattaatgagtattcttccgtgaattgctatttagacaaactttttcattactgagtgttctttggaatttttatacgactgagtatatgtatttctgatttgatctcatcatttccctgggctgcaaaaaatttacttggttttaaacttttgtatgcgtatacttttcaactatagagtcaagtagaaatgatttttttccagcaatcattcaaatgactttttataacttaatacttgtattatataaattaatgctgccttacagagataattttattgaatttgtggtagtgacttagtcctgtattttctttcttttgtctttagtaaggcattttatttattccaagttccatatattttttcttacattttaaacatctgtacagttgagatacatcttacaactaatagaatcctagattaggaaaaaagcagtattcaatgtcagtgggtcttacagatttcttcctctgagggatgtttacattaagacctgagcttaactgttttataaagtcacacatttcccctatcatcctatcatgctgccagattaagttgtaatttaaacggatgatatgaaaatggtgggtttttaaaaaaaaaaacccttcattttaagttcagggaatctgtgcaggtttgttacaaggtaaacttgtgtcatgggggtttgttgtacagattatttcatcgcccgggtattaagcctcgtagtcttgtactttcaaaggatcggctttcctgctgctctcttttcctatggtttatattctttgacttctttcaccagttttaaaggtgacagaatgtttgtgacaaataattttaaataatatgccaaattggtagaatttttaaagagttgtgttagaaagtataagagtttgctgtttgtttttatactcaaaaatttagatgctaacaaaccagttcatttgattttttttttttttttttttggtaagacattcccagaagtcttagtctttttgcctgtacactgggtcctatggcactgattctaacataacctatcaaaagaaaatctccacaaattcataagctgtcaccagaagacaggtaacactgtgataaagcataaagttactcttattttctctaaaaataggtaaatttgaggaatatatttacacaaataatggtaataatttgcgtatcaaaattgtaagattttaagcagaaaaataatattggagaggatgcagagaaaaataaaagacaaatttgaaatgattattttttctcaaaatatatggatagttattaagaactgatccaacatataaattgcaatgtgtggtggttacacaggagcacacatatgtaaaaatttcttgtgccatgcatttaagatttatgcatttgactatatatgtaatatatcaaggagaaaatagtttaaaaaaattagcaatgcaacatgtagaaatacatgtgcaataaacaaatatatgcacacgaataatttagtgtaaaaatagtggttttatcagtgacatatgcaatgacaaactattattagcaacatgtcaaatgaccattttgacgttacttattttttattcacacagtgagatactaagcagctgtaaaattatatcattctagacaagaatatgtaatgaaatttaaacatttgcacagcacattaataattataacaataaaagcaaattacaaaaatattcatacaatagtattacttaacttttataataaaatttatgagtatattagaaaaaagcaaacaaatttcctagaagatattaaagtaactaatgggggccactgggctgagactgctccagtgccttggtttcctacgtaagcaacacaaaactcaattcaatgcaaacagtaaaatgaaacttaagcttaaccaatcggaaaccaccaactaacctctaactagagactttccacccaaataaggcaaacagctacttgtagtctctcaagtaatttccttattttggctctccgttctgcctttacaagccttcttctcatactactggttttgagtgctgcctgattcttgaccaataagttgttttgtggaattgggagttattgatcacgtacggtgcttggagcttaagacctgaggttcatctaccactcattaccggagctcattaatgctgaatgaaactggtgtctggcttttctctacacacattgcctgatagagcagtcaatacctctcagaggaaaaatgagctcataggccaaaataataaaaagtttgaggaacacaactatttaaagagataaacatcttagtttcccttttagatcttatttgaaccagaaatagtacaagaaaatgcccaagaaattaaaattagcttaataaacagatcaaaagaaatagagaaaggtattaacaatgtgaaacaggaatagagcaatatggaagaaaaataaagagtagagatatacactaaaaataataatagcttaagtaaacagcacaatataaacagcagaatatagataacaaaagaacaaattagagtattaatctaatactcagaaaacctactagagggaagaaggaaaagataaaagaaatagaacatataatagaaaagttgagaggcagaatttaaacagaatgctaatatctagatgtgagttccaaaagagagagaaatgaaatttcagaagaaatggatacagtaataatggagattaactttttagaattaaaaacaataatttaaacaattcagactggaagacccttagagcaccaaaggggagaaataaagaaaaaaaaacaaatacgtagtcaaattctagtaaaatttaacatcaggttagatgaaaatctaaatgcatagacacagagagactcaattatttacacaagtacagatgatacctgatttacaatttcttgacttgacaatggtgtgaaagcgatatgcattcagtagaaaccacacatcaagtacccatgcaaccactcagttgtttactctcagtacagtattcaataaattaatgagatattctatactttattatgcagtgggctttgtgttagatgcagtgggctttgtgcagtgggctgtgtgttagatttttattatgcagtgggctttgtgtcagtgggctttgtgttagatgattttgctcaactgtaggctaatgtaagtgttctgagaatttttaaggtaggctaggctataatgttcagtaagttagtggtattaaatgcattttcaacttacaaatattttctacttgcaatggatttatcaggacataaacctgttgtcagttgagaagcatctatattaggttaacaacatgttttcaaatgatcttccaactctagatggaagatcagtctgcattagtatttccaaagtattaaagaaaaataatttacaacttggaatcctagatttgtgaaagctaccctttattatgattaaacaatgtaataattacttctaggcattaatgcttcagaaattttgccatgccaagactcacaatagaaacagttttggatgaagtaacttaaataaggggaaaattatcaaggaaatatttcaagatttaaggtggtatgtatagtgccaaatatatgcatacttataataacattatgtggactaaactcactagttaaaagacaaagattgagagtttggattttaaaagttccagaccagagataggttcttgtttttcagagtacacctaaagcataaggataataaaaaattgaatttaaagaatgtaaaatcatacaccaggcagatactaaccgaaataaaaccactataatattaaagccaaataaaataaacaaaaacaaacacaaaacattattgaggtaggaaggttcattaccttctatttgatagttaatagaacctgctattttcataggttctgttaaccgaaaggatgcagaaattttaaagttcgagtttctaaaatagcctaaaaatataaggcaaagaaggtaggtataactaaaggagtaagtcccaaactgaccataatggaaatattttgctcctgttattgacagataaaacagaacaaaaaaatagaaaatatgaaataagaggtaacaagtgtgacccactagctatacagataaaaataaaggttctcccccatcttattctcagaatattcacaaaattgatcaatactaggccataaaaggtctaaatttcagtgaatagattattatacaatatgtgatttagagaagtagaagtaataataaacaggaagaaagatagcattgctttttcagcactcataactcaaggaaagtatagcaccagaatcaactgcttccctttgttttctgtttgttttgttgttgtgttatcacattgtttcatatatgatgagaattttttttaatccttctattgtttgtgtatttctaactttgttactttaccatgcattttccctcccaaagccccccctcttaaatctcatacggcttttcattttaaataatagaataagtatttaggagtttatagcattatataatataaacttctaagtttagcgttcctatgtttctaacttcaaaacaaagccaaacaaacaaacaaaaaaatcaaacaaaacaaagcaaaagcttgttgagttaaagcagttacctgagttaggtagcaacataaataaagcattagtagatatttatttataactgaaaccaataatgaggaaattggaacatttacaaaaatacaaatttaaaatctatacttacatactttttagtctcagattctgaagtgaatgacaaattaaaacaagaaaattgtgggggcatgatacatgatttccatgatatatgctaacacatattctatgacttacttaacaaaatagtttcctttgaacaagatagtgttttaagtggaactgaagaagggtgatttgtgctgctgtgcctcaatggaattgctgaaaattactcttcttatcctttgttcctaacagtttttactttactttttcattgccagctggaaggaaaatgggtctacaaaaacgactcttagaagtaaatgagaattcattgaggaacattaagcgtttttggatggtaatttgcttgattagttgcaaacagcatatgtgttcatgttattcttagatttctcttgtgtgtactttcagaacatgtatcttgttttccatgtgtttcttatccttatcctttcttctccttggaagaaaaaggttgcctatgacaactaaagttatatttttagttcatttatattatttgcccaaatattcctttttcttccagtgtgaagtggaatgtaaccaaaatatatgcctgcatcagccagatgtcatcttcacttctctccattaaaaactgtagttgactttttaaggatccatgccagagaccagagaatatttaagctagacttcagttaaaataatttatttttactcaatccaaagtatcaatcacttttctacatacgcattaaaaacacttacacacacacacacaccaacctgtggacacacacatatttacaaggaaacatttttcaagcattttcaacaatttcaacattaaagcttaatttttgaaatcaagactatccagaaaatctaagatatatgtattcacaagcagttattacagtttaaacctactttggcttttcctgtttttaatctcagtttttcataatgagaatacacaccatctttagtttaggggatatgatttcaaattgattttattttgttcacatttaattatgttaataatattccccattaaaataggatcctatagattctataaaactgtaaattagaaaatgcatcatccagtgactcatttggtaacatatgtaagatccttgtggtagtcagcaagctacttttcctcagtttcaaatcttgccttctatatattgttttgggatgttgtggtcgacactctaccaataacatttttttattttgccagatagctccagccctgccagtagggggtggtagagacggtagtagtaggctgaagaagaacaaaaggaactgttgatttctgattgctttctgtcttatcagtcacccttcaggctgttcattccactggcagtggcaacatggcaattcccccatcccccatccctgccacattttgagaatcaacctgaatatgcttcagttggtgggctctccttcctcttacagctcaatcccagctccacggggctacttctctaagcttctgagggaccagtattagtccagcaggttctctcccttgggatctgaatcagctctgtagagctcccccatcttttttcttttcttttcttttcttttcttttcttttcttttcttttcttttcttttcttttctttccttccctttccttccttccttccttcctttctttctttttctttctttctttctttcagacggagtttcactcttgtcacccaggctggagtacactggcaaaatcttgcctcactgcagccaccgcctcctgggttcaagacattctcctgcctcagcctcctgagtagctgggattacaggcacccaagaccatgcccagctaattttttgtatttttagtagaaatgaggttttgccatgttgagaaggctggtcttgaactcctgacctcaggtgatctgcccacctctgcctcccaaagtgctgggattacaggcgtgagccacctcgcccagccccttccccatatttctaagtttcccacttcttccctttgttttccagccctagtgatagcagctggtgttgcttcctctgtgataccttaatgttccccttatttccgtctctgctcctcaatatctgattaataactctttatattagattatctttagcaatttttttttttgagacagagtctcactctgttcccaggctggagtgcagtggcggcaatcttggctcactgcagcctccgcctcccgggttccagcaattctcctgcctcagcctcctgagtagctgggattacaggggtgcaccaccacccctggctaatttttgtatttttagtagagacagggtttcaccatgttgggcaggctggtcttaaactcctgacctcagatgatccacctgcttcggcctcccaaagtgctgggaatacaggtgtaagccaccgctcctggccatctctagcaatttaaatggtgtactttctgtctcctggctggacactgacataatgcattttgttctaataatcagaacctctaccatttaatgggaggggatattgtaactactacatataacctgtcagcagatattttatttcctttaagggagtgagctttttgacacagactgttagataaattatttggaagttatttccagtatatcttttgagagtattagttaaaattgaaaagagtattgcagttacaattagtttactaaccaactcatcaattgatttaattatccatcagaaataaaaatcacattaaaacatacagttgtaaagcctacaaattattctgtacattttagtcataaacattgagaagcattagtcatatacatattagttctttttttctatgagcaagcaaggcatacaaattaataaatattaaattatccaatgatacaaataactatctgaaattggaataactttattttcaagcaattttttgctttttgtggagaggcctacataacaaggaaaaaattaatttaaaaaatcaaaattacttcatttcagggacatattaaccattcaacctttcaaccacatagtatttataaaatgtaaaaaatacattgacataatctagtgtatttctaatttgcaaggtctatgcctttcctcaccatgaccatgttgttctttttttaagctttttttaaacagttattttttcagctttactgagatataattgacaaaaattatatatattcatggtgtatgatgatgatttatgtatatatacattgtacaaggatcaccacaatcaaattattataattaacacatcccgcaccaaacatagttactatttgtgtgtatatgtgtccagtgaggacagttaagatctgctctcttggtaaattttgtgtaaacaatacagtattggtaactataattaacatgataatgttagatccttacagcctcttcatcctataattctttgtccttagtcaccccaagtcaccagtgttgataattcattaactgtctaatccctggccatgccatcaacgtcaggaacctaccccgtgaatagaaactaaacatatattgtataatcaattcagtcggtgttagccatgccagacggcgtgaaaaggggcaggcatggaactctggcacaaatgtgcatacgcagaagagactgttagttgccttccttaataaacatttcccccttattcttgctgacagcatcaaagatgacaatgttctcaggagtatgagtatatatttcttagatacacttgaagctaggttcaacaggagttcgagatcaacctgggcaacatggcaataccctgcctctaaaagacattttaaaaaattagccaggcatggtagcatgcacctgtggtcccagctacgtgggaagctgaggcaggagaatcatctaggccgagaagtttgaggctacagtgagtcgtgttcgtaccactgaactccagtttgggtaacagagtgagaccctgtctcaaacaaaaccaaaccaaacctaaattgtgtttatgaaatgtcatcagtaatgttctgcatattttcagggtgtttaattgtaaggcagtgaatgagaattatactcctggctaggagagcttagaaagtagtagaatagcatctgtgcggaaaattcctgtaaagttccagtaagctacaaatataaaatatataactgcagtcaagagctactgagacaagaactggagtaagacttaaaaaaaaaaaagctaaagacaggttgtcaggagctccactgagctggagagacagagctaaactgctgggtgtcagagagcagtcaattaaagcaacaagtcacaaatgaaagaatcctttaatcggtagtgaaattgcaaaagtaagaggctaaaaccaaaggaaaggctgactctccgtttcattttcccttaaggaatgtgcaccagccaaggggctgggggatcagcagaggcatggaggatgcctcactgttgagagaacttcaaacaaaaggtccccacagttttatcgagtctaggatcaggggaagcatgagggggtgggctaggagtagaaaagtactgggtactgagtcagagtggggaaaagtatattggaggttttctcctcctctcctcataaggagactttggcagaaacatccaaagaggacctcgattcaaggctgcagataaagagatgaagcttccagggctaggcatgaaaatgtgccaggagcatgaggggccagagagttgcagtccttgactacagctcccttcagaggctgcaattcactggctgtgcaccaagtgtgctgtgaggagggcagctttctcctttaacgtctatcaggtaaagtctttgtagttgcgtatttcaggccaggcctgaaaaaatcacacataggttttggaggtagacccttcaatatttaaataatttttgcatctgcttttgctctagggtcaattgatagctccaggcagcagcaagaggctcagaatcagagctgcgaatgctgttggaagatgaaggaatcagtagttatggtggaatttggcagcccaatcatatggtcaactttcccctgaaaacatttgctaaatgctgagctatagagagattaaaaagctaagaggacagactctgaaaagtataacagacctataagcaatcatataagacaacaactatggttcagaatctgagcccgggaggggtcacagagaatacacaaagcttttggctgactcaagatcaaactaaaagtagaataaaatgttaatgaggcttcaatgcagtcaagactcagaacagttccagataagcctctagtgttttatcctaagaggagaaagacaaatgttgtctggagggaaacattattaccttaaacctctacaatttttcactatggaatcactaacacttaataaaaattactagaccacaataaaaagctcaaaaacaacaaaataaaaaagtaaaatggactgaaagcacacttatggatgattgagatgcttgagacactggagttagccgagaaagacttcaaaacaagtataagtagagtattgcaatactagaaaactagatgaataaaaaggtgtttcagcagaaaattgacatttataaaaggaaagaaataaactttcagaactaaaaataaattttcaaagaatggttatatcaacagaatgaacatagaggtcaaaattctgaaattgacaggttaatacaaaattcaaaactgaaatatatagagaaaaaagagcatgaaaatagaacagttctaagagatttgtgagacaaaatagttttgatatatatgttatattcatttggagtcccaaaacaagaggggaaaaaataaggcagaggccatttttaaagagataatggcaagaatttgacaaaacaagctacaaaaacatcaaacaacagattaagttctgcaacacaggcaagacaaatacaaagaaaaccccacatcgtaataaaatcacagaaaagcaaagacagtgaaaatcgtaaagaaacctgatgagaagaaacattaccttcaaagaacaacaaggagatatgcagatgacttctgcagaggaacactgaacatcatgataattcagggtatatttaaaaggatgaaatataataactgctaatatagaatccattagtcagcaaaagttccttcaagaataaagtgaagtacagatattttccaagaaaaatactaatatctttttaaaaaatcacactaactggtattcataaagcaaaagaaaatatacagtgaaaattgaatacatttaaaaaataaatataaaagtaaatataaatgaataatgcctgtaaaaagacaataatgggtagtgttgatttaaataacaatttagtattaaaatgcatagcaatgattttacaaaatgatgggaaggtaaatagaattaaagtgctctaagcttctaacataataagggggagggagaggtaaaagcagtgattttttagattgcactatgtaaaagatgcatgttgtaattgttatcattattactaaataagaagccaaggtaattttaacagtttaattgagcaaaatgaaatagttatacaatattttattacaagaggaaaaaagaaaagagaacataaaacagatggattaaattaaaagcaaatgatggtagagtatatctgaacccaaatatgtcagtaattatattaaacttaaattaattaaattctccaattaaaagactaaggagccaaagagtacataagccatatgcacctgtgtgagtatcctggggaactatggggagggacaaaatttttataaactttaaatataaagtatataaataaaatagaaagtttgttgaagacagggggccaagggacaattctacctgtgaggaaaggagacacccaaattcaactgatgaaatttgggaaaggctcacagtggggaaaggaagaaatgtgaccttgtggatgagacctttggggtattcacgtttctgttgttgcttctatgtctgaaattgatgtgggacgcagttgtgcttctcttttccacgtgcactgagggatccctgattgggaagtgctgcaagcagagaagtgtcagtggagcacagtcctccaccatttgccatcggggaatgttggaggggaatggaagtgcctctatcctcttattttaaagtcttcagaatattggtgatctcctgctggttggcaagtcacaagcctcagtcacaatggcactgaatttagagatatcacactttttctctgagggatacctgatacactccaaagtagtacaggagcttgctctatgagagaagtttattcgggcctatgtggatggatttaaaaaacacaatccctctggaagtgagggaaaaactgacattgttttcagccttccaccaccaaaaggcagattgaaaagcttactggagtctgagtgttgagtacagtatgtgctacacttggcccttcatttgttcatttatgttggctaacgtgcaaatcatcaccctttgaatggatcccaaactagcaggcagaactggaagctatccagcaagctgaagcacacgctctacctatggaagctccccattttaatgattcctttgaactgtaaccttcgtgacttataattttgctgattggaccctctagcaaagacaggcagcctcaaaataacggttctccttggagcttagaactggtcaccttcctgacacagttactaggcacactccttttgaaaagtggccattagtttgccactcagctcttgtcgaaaatgaatgtctgatctggggaggctctgtgattctccagcctgaaattcacaatttggggtgggacaactcagatacaatgactaacacagcaggaaacaccccacaagccttatttgtcacattgaaagagtatattcagtcttacagcttgcctggctctaacgctatcttggctctatataacctttggggaaaactttatcttctgttctgcctttggcagtacagcccctggcttaatggtgcgtttggtttacagaaattgcactaaatgcctggttcttgtaccctagtggtttggcaacactgaaatttgatgttttccgttgagctgttgtggaactgaaaataggcatgattcttccactcagtggggagaatcaaggttggtctcgtagctccagccgataatgtgcttaataaaacttgttagagattttctgatacttgatctgttgccaatggcctaactcgttggtatcccacctgaaaaactacacacgggcagatgaatgacacccttcttggggatgctaactgtggaaaccttgtgactggtgattagacaacctacgtgactcacagagcaggctggatggttatgttgaaggtactttgaacctgcacccctcacctgatgtgtgtcacacacaagtgcccccaacaattgcaaaaatactttatctctggggacccatgtggtcccagaataatacttcttgtgtagaagcccagcgaattgtatcttaggggtggtcatagagatcttaaagtgtttaaagaaacacattagaccgtgtaaccctcagatgattgtgggaaacctctgaaaaatgaggacccagatgggagcttctagagggataaatgactcattattttgtgctagaagttacctctattatcggagtcatccaattagaaaaagtagtataaaatttgtccttgactatagctgaagtgaacaatgacacagcgttagccctggaaggcattcatgatagccttaactcactggcccaggttgctttgaatgatagaaatgctctagactttcttcttgccagccaagacggagtttgtacaattactaatacatcctgctgttcttgcattagtgtttctggcaaagtggaaagctcaatacaaagacttaaagagaaatccaactagctttctaaggtcaacactgatcgtttatgggatttgttgaggggcgctgagccctgggggtcatggctaacatgatactgcagattgacctcattgtgctgtttggagtcctattgataaatgccttaattaaatgttgtgtgagacaaattgaatagattttgtcccagcttctgtcaatcggattaatcagagtggatgacaaagttgcgtatctctgggaatatttgccagaagccaagacagtgtagaacaaagaacagatattattaagatacaatattctccatagatttattttgtttctgcagggcttgcaaacataggaacttttagcttttgttctgtactatctatttgtattaaaaaacagccttgaaaaatagagataatttttaccttaagagcagagggcaggtttgcttacggcctaatataaaaggtttttgttccctaagctcgaggaacctcagatttgaaccaaacccactgcatgggtgccatgcatctgagcccctccttttcaaacctactggggagcaagtgatgtgagcatcatggccatgctgctttctgtgctgtgagtaataaagtccctttctctgacccaagatctcgtatcttctgccaatatccatgaaactgtggtgggataatttgttagcttaatagtgtgacagaacctcagacttttcaccattcttgacacacgcatcacaagcaagtgatatttcagctgggaaactaagtgtggttggtcactcaaaaatcaagcagtgcatggaatttctgataatggcagcatgaaggttgttacatttcttctgaaaatcacaattactttaaaaatggacaaaattattaaaaccagtaatttgaatgcaattaaattgcaaataaatcaccaggaaagcgaccggttacaagcacaaagtaaaggagagtttactattgaagaaatgcaactgcattggttaaaagcagcaattgtgtgactttcttgactgagcgtgctctcttacacccccaggtctaagcatggccttatcagctcaaggtgagagatgttagcactgagagaagcagacccgtggaaattgaaagggaaattctagaaatgaaagagccacataggtgctgagatttaaaatcaaagtccatgttcccaaattcctggctcactgctaaactatgcacgtgtgcaggaggctggcaaataaagcaggcagaaactacagagaggcctactgttcagaagcagactgcttctgatgagatgagttcaccacacccttgaatgtatgggttcctctatctatacagctcaaaatatgcaatgaaaatgcaatgctggctagcttgagaacacagggaaaacacagggaaactgggactggcatagcaactggaaaattaagcgaggagccaggcaaacaagacaaacagataagatggacccaaaaatacagtataaacactgaactgactgccaaactgtttagggacaagggacaccctctagacaccacattacaaaagcagaaaggcgaagaccccccacacacacacacacacccaaaaatgagcagctgcatcacggtgtggggaagaatgatgcagcagggtgagttcatgctggttaaacgcctagtagaacaccacaccagcaatttctgtaagaaaaaaattgtttccaaagttattccggctttcttttgattagtgttagcatgatatatcttttttcattccattacatttaaactattttggcctttatacttaagatgtgttttctataggtaatatttagttgtgtgttacgggtttttaaattgatatataatagatgtacatagtttcagggtacatgtgaaaatttaatgcattcatataatttgtaaagatcaaatcagttacttgggatatccaccaccttaaatatttgtcttttcttttatgccagcaattccagtactgagtatacaaccaaaagaaagaacatcaatatactgaaaagacattcatgtttattgcagcactattcacagttcacaatagtcaaaatgtagaattaatctgtgtctattaacaggtgaaatgttaaagaagatgctgtatatatacacaatagaatattatgcagccattaaaaagaataaaatcttattatttccaacaatatggttgaaactatatttacatgcatataagatctgtcaatctttctctgtcaattcgtgtgataggtaatttatatttgattctttatatggttaggtttaaatctactatcttacttttgttttctacttgtcccatctattctttattccttttttctcttttacttattcttttgtattaactgagcatttttaataattctattatttttcccttgttggctcacttctcatgactctgtatagtgttattttcatggttgtcacagagattatagtgtacatctttaatttatgacagtatatcttcaagtgatatcatattacctcatgtatagtgtaagaaccttgaacaatatacttctatttctttcctcccagctttgtactattgtcctccattttactgcgacatatgctatatatctatcaatacattattatttttcttgctttaagcagtatattatcttttaaagggacataaaataaaggatccaatctctacatttacccatgttgctaccatttctggtgctgtttatttctctgggtaaatccatatttccatctgatattatttccttccacttgaaggacttctttgaacacttcttttagtgaagaattcttgataatgtgttctttaaggttttgtatgcctgataaagtctatttttcttcagtttagaaagattattttctctaaagaattttagattcactttttttctatgttttaaagaagttgctccattttcttctagtttgcagtgtctctgatgataaatctgatatcacacttcttctttttctctgtattaacttatcgtcaacattgtattggatgttatagccatccaataaaccaagaaaaaaagaaataaaatgcataaagatcattaaaatagaagtttaattttttctattttagatgatgtgattgtttaggtaggaaattcaaggcaatctacaaaacaatgagtagaactaataggtgggtttagaacaatttagttaatatacacaaatatttatcctatttccaaaatccataaaatacctaggaatcaatgtagcaaaaatcacccgtgcttttacatcaaaaagaccaaatattgatgagataaataaaagagtatccagataaatttaccatattattagattagaagactcaaaattgttgagaaattctctcgtagttgatctgtagattcaacacaattcaaataaaaattctagaactttttaaagagtaatgaataagaagatcgtcaaagttatacagaaatgcttagaactaagaatatacagggcagttaaaggaagaacaacaacagcaatgacaacaacaataaggaaacaataacaaacttggaagatctttcctacctgatgtcagttcctatgaaaaagccacagtaatcaggacaattttgtattagcaaaagatgggcatatatatcaacagaacagaatggagttgagaaatatatatttatatacatatacacatttatagttttctgtacacacatatagaaagtataacgtatttacatatatagctaattgattttcaaaaacatgtcaatgcagttcaatgaggaaagcaaagtcttttcaataaatggtgctggatcagcagtgcatctatatgtaataaaacaaaaccaaaccatgaatccttacctttcaatgtacaaaaattaacttgaaatggatcacaatctatatgaaatacctgacttataaaattccaggaaaatatttggagaacatgaggttgacagattgcttggatagatgcaaaaaaagtccaaaacgtttttcaaaaataaattggagctcgttgaagttaaaaactcttgcttttcagaagataccattaagaaaatgaaaaagacaagctgcagacatataaaacatttgcaaaacatacaagattcatatccagaatatgtaaagtactcttagaactcaataataagacaaaaacaaaacaaaagaatacaatgggcaaaagatttgaacagatctttcaaaaaaaaagtgatatgcaaaatggccaggaagcatatgaaaaatgctcaacctcattactcatcagaaaaatgcattaaattaactaacattaagagatttgtcacacaaaatgttggccagcatgtagagcagctggagctctcacatactgctggagaaactttaaaaaggtaaaccactgtggaaaactgacggtttcttgagaagtctaacgagtacctcccacacaattcacccattccactcttagttatttactcaagagaaataaaatctaatgtccaaagaaagactcacacaaatgtttagagtagctttatttctaagatcacaaagtggcgaaaacccaaatgtccaaaaataggtgaatagataaataaattgtaatatattcataaaaaggaatacttctcatcaataaaaagaaatgattattgatacacagaagatacagatgtatttcaaaataattattttgatgaaagaagtagggcaaaaaatagactataccatacaattccatgtagagaaaattctagaaaattcaaaccaatctatagtgacagaaagcagatcagtgattgcctgagattgtggctggattgataacaaaggggaacaagaattgcatctggattgataacaaagaggaacaagaaaactttttattataatgaacatgttcactatgctaattgtggtgatgattgtataagtatgtacatatatatatacacacacacatatatttgacatatatatataaaatgatcaacttgtttaacttaaataggtaaggtttattttactttatatcaataaatttgtaaaaaattatcagttttcatttgaataatcttactaggattttccatgctgtattaaatttcacaatgaaaatataaacatttaacattttttctatatttactatttcgtacgttctacttttggctttaatttatttaattttacataaatgttggcatatttaaattgcttattatttgggtacactgagatttttcaatcattttatatctttagatatacatatcaacgagtggttctcaatgaagagtagagggtaattttgcccctttcctctccagggtacatgagatatttttgattggcacatctggaaaggtgctactggtaactaagaggcagaggccaaagatactgataaatatactgcagtgcacagcacaggccactcaaataaagaattattcagcccaaatgtcaatagtactaagactgataaattctgatgtaaattatttattcagttgtgttttaaaataaaaaataaaaatgaaccaacaaagaaaaatatcaattttaagtgcataaaaaaaaattaattcaaagtaattttgttgattagtaacagattagacagtttataatttaaattactttggaaaatctacacatttagtataatgcaacattctggcatcttgttaaaattttaaaaatggccttttcattccgaaaaagagacttataataactcctagagagactcagaataactattagaaatgtttccaattagcagttatatttgcataaaaatatgagacttcattatattttacagtaatttaagacaatgataatgtcctaactatctaaaacaattgaaatctgagtattaaatactctttcttcctttcccaacccatcttgccacacatatcactgaaaccctattgatttcactattagttttccaggaaatcttttcacgaagagaacaggtgtaaggaaaattacagcataataaacagaacaagaatgtactatagcctatggaatgtagtgatactttctattatttttaaaactctattgttaacatgaaaaatggcatttcacaagatcaacttaataaatgtcttttatgaaaatagtgaattcagttacactggttaaatttggacatatttttcatagcaaatgttttaaaactttattcttaagacaatctgcatcttcagaaatatcctctatttcattctattactttccaagtataagttatatgccttttcattattttgttatcaatttggaatagtcagttagaggaatgccatagctttcaccctcttgatgtattttaaatccactttaaagcttagacataaacatagtagcacaagactaatttaagattagatatgaggtatctttctaaatgttgttttaatttgcccagtgggaaaagagaaactctgcagcttaatcccattaattagcttttggcaaactcagttacaaacagttttaaatcctatctcattctagtgtatggaggtttagtaaaacgtgctgatagctctagcttgcccttactgttctaattttaatcacgcctctaactcattactgctgtggcctccttctacaaagcatagaaggaagttgcttccagggactacttttttaggtttaactaaaaacatttcttaaaaggacttaaaaatagcatattagctatactacaccttaaataaatttatggtttcaacatatgaaatctgaagcaaaccttatgaataaaatttccaatgctaacactcagttatggtatcatgatgggttgactataatcaggagagaaaattaattccccaactaggcaagctttgcttacattgaacctacatctttataatgaaccacaaagagcattgtagctcactaatatgtgtaaccctaaggaatagctgatagaaaacaccacaataaaagaaagacaagcctaaaaatctactgtagttgtaaaaagaacatcagggaatgcaattcccataagcactgtctgtgttccataattatttttaggcagcaaataaaaaggttttattatggagatttggatgactacccttaaaagaagaattcatatagatgttttaaataaaatcactaggtctttgataatagtgttgattttcttaaaataataggaccatcaccaacatgttgctggtagcaaatttttcatcgagactttttcatattcatattttttattaaactgcagtcaaaaataatcttgcacaagaatttctttaatcaactatctctccagtgcttcaatgttcttcttttctctttttattttatttttaataaattgtttcccagtttattttggtcttttctggattctgcaaacaattattgagagcttagtgtattctaggcattgtgttaagcacataaaaatattgttccctctaattcaacaacaatcctatgtgaagataccattacacgtcacagaattgtgaaagatggggcttacaaggttaattactcagtcattcagacagaaagtgacagaattagaatttagaacttcctgttgcccaagcctaaactctgcctccctgattacttttcatatcactttccctcatatactacttgtccacaatatctttctgtttcctaaatgacagcagtgttcctcaagtcactgagtttaaacatgtatatataaattcccatactgaacttcatctttgactgacttagtattccttatagttggaatgtgtcccccaaaagtttacgtgttggaaactaaattcctctgctttcatgagtggattaatgttgctattgtgggagtgtctttgttaaaaaacggagttatttctggctctcttaccatgtgatgatgcagcagtaaggccctcaccagatgctggcaccatgctcttgcacttcccagtctccagagccttgatctaaatacacttcttttctttatatactacccagtcagtgtttatctgttatagcaagagaaaaaggactaagacactaaatttattttacaccaaaagtaacttgaagaagaaagtagataatttatttacttaacaagtagagagtttaattactgataaccatacagcaaagtatgataaaatattaacactaatttcatataaacagaatataaattacttttgcattgcttaaattgcctaagctactttaagtttaaaaatggtgatttacattgttatatcaagggaaagctgaaattattccaggaatagtccaaagtcttgcctatttcatagtggcctccccatccaagagaaatgtcactaccatgactaatgcagatactagcggaaagggaggaaagggtcattttgggctcagtacattgaacatctgttagatttagaggaaatgcagttacagggacctgatattgccaccataattattaatgaggatgttagaagactaagaacttagatgtgtgaacatctggaagaaatatgtttggttcgataaacatttcctgaatggtgggacatgctatttcttccttttctcagcaagttcactatctactgtgttttataatacatcagtataattatggtcgatgaatgatatttatatattttactaatttttcataattacatatttgcatgtataattattatttactgggataatatacttaggtgtcaattacctcttcttaccttttcctaagtcacatgaaaaccactaccttagctttacattaaaatacactaaacttcttatagaaaggaatcctaactatgtaacgcattagtaattctgtttcagagttttatctctaaactttattaatggttaaaatatcttaagatttagataacttgaagccctatgatgtaatcagtaagtctatcttagcacattttctgctaatgtctgcagctaattctgtattcaaaataatgatataattggtaaataaaatttaacagataaattctgttacttccacatcacaaaagattttaacactgtataaaatgattgtatgtgatagctatatttaacattaaatagtgtaagtggtaaccaagtaattggaaatagttcaggtaaaaaggaggaagttgtagaagaataagatgactcatgtaattgaagagaggacaaacttaacagctggagctcaggaacttcatctttcatattgtcttttttttttttttctacaggagctttcagcaaacatcaggaaatgtggtatctgccactaaattaacctcactttcatgaatgcccctgccacagagggattgactgaagcccaatagacccaaagaaggactcagactcaccagcttgggccatgtttccaccactaactgaagtaactgtggctactagaacatgtagcctgtgctcttagccatagtgcttcagataagcacaataatattagtgatctatcacttacttctatactatgtgccaggtacaattgtaagtaatgtgcatacgtagtatggacttaatctcaccacagccctataaggtcagtattattatgatgacattcattgcatagatgagaaaattgtagcacaaagagtccaagtaagttgctcaatgttttagtaacttgcataactagtaagtggtacagcagaattccaaactcaggcaatctctgactttcagttccatgtgaaagcaaaagcaaaagtggggtttttgggaccttaatatgctatactctgtcattattttatagaggtacttcatagggcagagttttttcttcctaattcattcgtttatgaaatactgcctttcagggtcttggctctatttgaagcctaacaagacttccaaaattttgctggccttaagtttcatttccagtcctctctgtgtctgtatgattaaactcaaaatgtctagctaccaggaatgagcagatgtcctcagagcaagtactggctttagaggattgttgcttttgtggattacacattctcaccattttgatattgacggatttctctcccttttctccacccaaatgtgaatttaaagagatttattattttctattcggcataaaagttggtctttaccagtaggaattgccacaaaataaagtataatttttattatatttagaaataacagcaagttcttgagtaaacatagtgaaagttaataaacttatcgtgaaatgcaaaggtatgcagataaaatatctaattctttatttttttgagacaagtttttctctaccactcagtctggagtgcagtggcacaatcacagctcatggtagcctcaaattcctgggctcaagcaatcctctcacctcagcctcctgagtagctacgactacaaacgcaccaccacacccagccactcttttcattttttgtagagacagggtcctcctgtgttgcccaggctggtctcaaactcctgggctcaagcgatcctcttaccttgaccacccaaagtgctagcatttcaggcatgagccaccacgatcagtctgaaaatatctaattcttaatagaaatgtgatttgagaataaatcaatagctgtaaaaactccatattagtagtgtccatccatttgtaaatttgaaaattgtttggtgctcataaatgtcaggaatctactggagaatctaaatatagaagtggaatttcttttctttatactctagcataaatttgtctatattttttaatttgccaaggcatgctaagatttgtcaaaaaatataatttcaacttttattttagattcagggaatacacgtgcaggtgtaatacatgtgcataccgtgtgatgctgaggtttggggtataaaaggtcccgtcatcgaggtagtgaacatagcacccaatagttactttttcagctcttgctttcctccttctcttcctcatctaataggccccactgtctattgttcccacctttatgcccacgtatagccaatgtttagctccaacttataagtgagaaaatgcagtatttggttttctgttactgtattcatttgtttaggataatagcctccagcagcatccatgttgctacaaagaatataatttcatcctttttatggctatgtattattccatagtgtataagtgaaggagaaactttatatttttcacacaagcagtcaccaagggaactcattaccactaggcaagtcttacaagagatccttaagagaattctaaacagagaatcaaaggaactatacctgctaccacaaaaacgcacataaatacatagtccacacactctataaagcaactatacaatcaaaactacaaagcaaccagctatcaaatttacaataggatcaaaacctaacatataaatattaaccttgaatgtaaatgtgctaaatgtcccacttaaaaaggcacagagtgggcctggcatggaggctcacgcctgtaatcccagcactttgagatgccgaggcgggtggatcacctgaggtctgcagttcgagaccatcctagccaacatggtgaaaccctgtctctactaaaaatacaaaattagcagagcgcagtggcatgtgcctgtaatcccagctactcaggaggctgaggcaggagaatcgcttgaacccggaaggcagaggttgcggtgatccaagatggtgccattgcacttcagccggggtgacagagcaaaactccctcccaaaaaaaaaaaaaaaaaaaaaacaaaacgcacagagtggcaagttggacaaaaaaagaagacttatctgacttctatcttcaagagatccatcccgtatgtaacaacactcataggctcaaagcaaaggattggagaaagatctatcacgcaaatggaaaagaaaaaaaggtcaggggtcattactgttatgacagatgtaataaaagggactttaaaccaacaacaataagaaaggataaaaaagggcattacacaatgataaagggttcaattcaataagaaggtttaacctaaacatatatgcatccaaccttggagcacccagattcataaaaaagtacttctagacctatagaaagactaaacagccacacaataatagtgagggatttaataccccactgtcaatattagacagataatcaaggcagaaaactaacatagatattctggacttaaatttgacatttggccaattggacataatagatatctatagaatactttacccatcaaccacagaacatacattcttctcatttgcacatggaacatactctaagatagactacctgcttggccatagagtaattctgaataaatttttaaaaattaaattcatatccaccacattctcagaccacagtagaatagcaattgaaatcaataccaagacgacctttcaaaatcatgcagttacatggaaatcaaacatcttactcctaaataacttttgggtaaacaacagcattaaggcagaaatcaaaaaattctttgaaataaatgaaaatggagattcaacataccaaaatctctgggatgcaataaaagcagtgttaagaggaaaacttatagtgctaaacacctatgcaaaaagtttgaaagatctcaaattaatgatctaacatcacaccaagaagaactagaaaaataagaacaaacgaatcccaaagctagcagaagaaaagaaataaccagaatcagagcagagctaaacaaaattgagacccaaaaatctatacaaaggatcaacaaagccaaaagcttgttattcaaaaggataaacaagatcaatagaccgttaactagattaacaaagaaaaaagagagaagacacagataagcataatcagaaatgacaaaagtggaattacaaccaatatcacatacaaaagatactcagagactattatgaacacctctacacacacaaactagaaaatttagaggaaatggataaattcctggaaactcaaaactcaagattgaatcaggaaaatattgaaaccatgaacagaccaatatcaaattctgaaaacaaatcagtaacttaaaaaacctaacaaccaaaaaaaaaaaacaaaactggaccagatgaattcacagctgaattctaccagatgtacaaagaagaactggtaccagtcctactgaaactattttaaaaaatcacagaggaactcctccctaactcattctctgaagccaacgtaaccctgataccaaaatcttgcaaaggcacaacaaaaaaaagaaaacaacaggccaacatccctgaggaactggatgcaaaaatcctcaacaaaatattagcaaactgaattcagcggcacatcaaaaagttaattcgccatgatcaagtaggcttcattcctgggatgcaagattgtttcaacatatgcaaatcaataaatgtgattcaccacctaaacagaattcaaaacaaaaaacatacgatcacctcactagacacaaaaaaaatcttttcataaaacccaacatctcttcatgataaaaaccttcaacaaactaggcatcaaaggaacatgtctcaaaatagtgagacccatgtatcacagacttacagccaacatcacagtgaatgggaaaaagctggaagcattctccttaagaacaggaatggcacaaggatgcccactctcactgctcctattccacaaagtactgtaagtctaaggcagaacaatcagtcaagagaaagaaataaaaagcatccaaacaggaaaataagaagtcaaattatctgtctgttaaaaatatgactctaagatatgtttttgcatatagattttgtctaattgttttgagaataggtagtttgtggctgagtttcttgaagatgagcaaatcgggaaatgaaaaaaaaaatggagaaataaaaagttctcccaaaaaattgaaaataaaggaaaatggcaattatttgagaaactctaaaagtcaattcatgatgagtgaattataaaataaatagaaatggatactttttttgaggcacagatgggctcacagctcctttgggtataatgcaactgatatcacctgaggagaatatgattcttatcctttttcgtctatttggtggaatatattggtagactaatcatcctagttaaacaacaaaattttctgttttaagtatgaaatatatcttcttagtttatccatatgttggcaagaaagtaaaaaatactaaggttacagcttaggtaacagtgggtacatggtaagtctgtgaaatgaatttttttctaaaccaagtgaatctaaacactagttttcatatactttgcaaagttttatgcgtagaagtcataacagtcttcctaccctactaattactggattccaaaaaagccataatctgagaataagggggaactagaaataaccccaattaaccacaaagaacttcaaggaaaaggcctgcaatgtcatagttttcctgttgggaagggaaaatatatccccttgaaaacatgtaaaaatacgcctatcttcacagatgccaggctgaagtcacactatctgagacacacacacaaactaaaactgtaaattttacttactgtttctggactgtcctagcagaagcaaactaaatctgttctggagaaaaaacactccagacctcaaagttttcaacatgtaaaatgtcaaggcaaagtgagcacctcataggaaaataaaatcacagaaacatataaagaaacaaagcaccataagcaacactggaagaaataacaaacagcaaaacctggcctgcaaagtcctcattaatgggaattataaacattttataaaagtagaaaaaaaagtttaaataatcataaggcacaagaagattgggagaagaatcaaaagaaatcctaaaattaaaaaaaaaaaacttgaagtttagaattttattaatccaaactaaaaactggagaaaatatccaaaattcatttcaaagtaataaaagaaatggaaagtgtgatacaaatcttaaagctatgggagagttaagtcttaatattttggatggggaggagagagagactaggacagaggtattagctaaaggtataatggctgagaactttcaagaacttgaaagacaccaaatgcagattcaaaaagacttgatttttaaataaaaataaaaaatgaatccaacaacatgtgatagtcagattacaatctatcaaagacaaaggccagacatttagagcagccaaagagaaattctgacaaaggagccataattagaatgacagctgacatccttatgaaaataatgaaaacttatacatggtataatatcttcaatatgctgaacggagatacttgtcaacctagaatagtacagccaacaaaaataatctttctcaaaaatgaaggaaatatatagaccacttcatacaaccaaaacctaaggttgtcaccagcaaatctacagtaaggtatttaggtggaaaaaatgcttttagatagatgggctgagatgttagatgctaaagcttgaaatttgcaaatatgtggggaaaatgtaagaaaacattcataggcagaaactctacagagtgattaggggattggactctgaagccaacaacctgaattgaaaatatgactatcatttagttggtatgaccatgggcaaattaataaacctcaatatgcctttgttttctcatttgtacagtggtgataataaagtcacctctctcatgggtaatcataagaatgatatgaaacagtaaagtacttagtaaagtactgggaatatagtgtgtatgttatgacaattattactacataaatagtaaaataataatgataatgtaataaataataatgtataaaataatgacaatgttatatgggatttaaaatatctaaaattacataaaaagtaagaagggtgaacataatcacattgtttggggaaaatatgaagatattaattaattttagattttgataagtttgcatattaaaatttctagagaaattgccaaaagaataggcagtgaataacttccaaagagtaaagaaaaaaatggcttgaaaatcaattcaagagctgatttgtgggtgggttcagtagatgacatgcattgtcaggagattggaaggtgagaataagagagaaatcagtgtatttttcccttccctttcctccttggatcatatctcaggaagtgattgctcctccatggctctagctcccactggatagactcactatagttgcactcatggctggctgactcatcaggttctataatctggccttttccttttgtctgtctctagcctagggaaggttataacttcctactattgctaacattgcctgctggttagtcagtctttccactagctgtgtaatcatggattaaattacgtctgttcaaacactgagtggtttttgttgcccttgttggtccctccctaatactatgatgatggatttatccatcaaaatatcaaagcacaagatagtaaatatttaaataattttttaattacccttgttctgattccctgcttactgagtaactttctagtcatgagatattttccagatggtttttttttgagggagaaagtgtattaattattcctaagcaagttccttccttccttccctccttccttccctccttccctccctccttccttccctccttccctccctccttccttccttccttctttcctccctctttctttctctcttcatcttcctttctttcttttactttcctaattatattcctgtgtacctgtaagctttgaaaatggaactgtgctctagaaaggcaaatctaccttgagtattgatatttatgtgtctgattttacaatgttaaagaccagacccaagagagggatgaattccctaaattaggtatattaactgatagccacttggtatttcccataaacagcttccaatattatttatttatacttctttatgtagacagtattttttttattttaaagagtgctactttctacacagattctgagaaagaaaagtacattgattttgctggtagaaaattcaaagaacactcattttctggtatcaatggaagtgtggctcttggagataataaaacctctatgtatagccttttgcagaaaaaaactctaaaagtcttaagcagcaggtcttttaatactttagaaatatcaattctttacaaaaagcccttattttctcattaggcaaccttaagatgtccaacccagctgttttatttgtctaaacaaatgggaaatgcaatttcataatgataacttaactctgttcagaaattggcaactcctcctttgtttcaaagtttgtctgaccatgctttctttcgctcagtaattctcaatatgtgcttaatatatcctcagtgtgtggctcaatatattctcaatccacagttgctcactgcaatggcagtcagatagggcctgaggggaagcactacagtaggggacattgaagggaaaatcttcgtgagaatcttaaatgttcctgcctccatcgccagtcattcttaacataagatatatgatgtgagcaattatttctagtaaaatattaaatttaaaatgttttcctttcagtttaaaaatgcagatttttaggcactttgtgggaggatatttcctttaaaaaacaagaataagacattagagaacttcatggcagataaaaacattcaaacttacattctgatggtaaagagctgaatggagtagaggaatggaatattaaagcagaaaacttaaaagacaatttatgtaaaatacaggaattatttgaaaaggaagaattttatgcaataatctaataattacttaaattattggataaattgtgtaaggaggagagccactgatttaggaaacagaatagctcactttctcatctgcattttttcctatcacagatttcaatcaggattggtctaaattttgaatgaggaaataagtgttaagagagaaaagggaaaaactatagatgattctcaacttatgataggattacatcctgataagctccttatactataacttgaaaatgcatttaaagcagacaacacagcagatggtccctgacttaacaatgattcaatttattatttttttgactttaggatagtgtgaaagcaataatacatttagtagaaatcgtaaccccattgtaagttgtaaggagctcctcaacttataatagggttatatcccaataccacccgtaagttaaaaagtagtaagttaaactatcataaatcaggaactgcctgtgcaccaatataaactcatggaggatcaaagtggtagagttgcaagaaacatcacagacttgtttatttccttaaactcttctgcatataatagactaaatctagggagagaaagtgactagctcaactggctggtgccagagtctagttcagaccttgtggtcttcttgctattcaaaatggggtgcagagaccagcagcatccagtatcacctggaaacttgttgcaaatacagaagctcagcatccaatctgaaactctactgaacttgaatctgcattttagcaagatcccaaggtgtctctataaactttaaaatctgaaaagtgttgctctaaaggattcacattgttttttagttgttttccacagctgtcttgttgcctgagaatataatgtccccatgggcaggaatttgttctctgtttatttgtgtcttccttagcaagaagttacaacaggagtaggacaacatcttttatttttgttgtttattttcacagtgtataaaggaatacttattttcagtgtataatataaaactaagaacctcaacaaatattggtttatttgagagcaagattattttcttaacttgttaaccaaaacaatcaacatatactacatccctggagagcaaagccctttgaaagaaatagagccaccaatagacttagttagttgtgtacattctataaaatcatgacaaattgtatggctagaaaaaccatcttgagaaagtcacctcaaatagcttatgaaaacaggcaagacaaataaatcatttaaaaacaaacttcatgagcctggtacagaacatgcactcattaaatacctgttgagtggatacaattattgaacatgattttactgaaaatgtgcctctgtaacattaaatacaagctaatattttgggaaaattaacttaatgatgggatgtttctatacatcttggtttctgcccatgctgtgtctgtcttttctgacaaaccaaaggattttcattttctgagaaagcaaagcttatgtaatgaatttcctctctttacagtgtcatgtctgtagattactgggtttgtaagtggtgcagatggtccactgcaccaaacaccaacaagaaaatgtttgtaagatgatgcttataaaggtaaagatttagttgagaaatatgctaacttcaggaaccaagagtatggcagtttgctatagcagcccaaatggactaagacagaaattggtactgagaaacaggggcactgctgtaacaaatacctaacaatgtggtagtggtggtggaactgggtaaaatgggtggaggcgagaagaggtttaaggtgtatgctagaaaatggctacattgatgtgaatggactgtaaaggacaattctggtcagggctcagaagaagaagaggagagaggtagaaaaagtccctatcttcttagaaaatacccaagtgttcatgagcagaatgctggtagaaatagggacagtaaaggcaattctgaaatgtctcagatcaaaatgagaaacaagttattgaaactggagaaaaggccatccttgttacaaagtagcaaggaattgggctgaattgtgtttgtattctagtgtctgggtggggtagaacttttgagcaatcaaattggatatttgagaaaatttctaagcaaagtattgatggtatggcctgttgaaagcttacattacaatgcaaaaagagtaaaattatttagagacttggaaactgttaatcaaaagagaaagagatcttaaaaatttagaaaattctgtgactatctatattggaaaaaatcagaaagcctgttgatgagagaacaagggcgtgaccagctaatcttctgatagggagattagtatggatcagccaactcactggaagccaggtgctattcatcaagacaatggtcagccatctaaacagaagccaggacctactgtgcaagaaatggaaaatagccccaaaggcattttggagatcatttggggctacccttcccatcacaaatgcataatacaagggcgtggaggacagaatgggggcaccactgcccagtacaacctcacattactggctctgctccccaaattctgttgccacactccttggctgcccaagtgtgactctggtaggccccagtgaaaagtgcattgtgcccaggaaagctatgagggtatgactgccttcacctacattttaaaggatgccctggagagcctagggtcccaggcagagaactgccatgggagtggggtcaccctcagactccactaggccccaaaggcatgccaacacttgcttttcgaaggatgactagttttctccggagaagagcatggccttgcttcagaatcctaggaatttgtgatgtgactcttttattgtagttggctagagacttgcatggcaccttcatctactgccagtacctccaacaccatgtaccattgatggcatttgggaaaatgggacagcaatgatgcttgtacccggttggaacctactaaggtcctgtgttgccctaggacccactcaagactaatagccttttaaattatccagtaaatgattatgcaagtattatgcacaacaacagttgtgttgtgtgctgtctccaaaatgttaagatgtttttcaaacactacagttcttttcactgttgagattcaagattaaataacttctttaatttgtgtggccctgttagcatgcccagaccagtgggacttaaaaaactttactattgtggcatgtctataaatttttgtagagtttattttgtaaccactcacatgcatgtatgttacaaagattctattaatctaatgacattagtagagaaaatcagcatattgttatgtagtacattcatatgatcagtgtccctttgaactatattatgatgaagtgttaacgtagccctggagaagatcacgaatgagtgttgctgcctagtctaacgaatgtgtactgctccggatacccttcctaacagggactgaaagcacatgcatttgccaagcaagtaactttatacagagaagctgcactgattttttctagcaaagacaccacatctcatacaaaaactatgattaagtgaagtgtttaggtttatggtggtgtactctctgccatgattaatctgttttttgaaggccgcacctgtgagctaagtggccatatgttggagaccaccatcccccaactttctccatttcagccagtatatttttccttgattggcttgaacagggagtatgcagtgtaaattcattgtcttctattttgccattttaccatattttagctcttcctccacaggttaagaaaccagtgaaggatctccagtgataaatatgtccatcctgatagtgcattctggaactggagacatgatcacaaagtgagatcatggtcctgttagacccactgtgagacagccttggaaaaagtctcaatctgtctgcccgcctttctatgccccagtttaacagggggcccatgatgatagcattagcgtcaattcaggtactctatacaacaacccttgaaagatactggtattcaccttcaattactgtacacctctctggtatattactacacatttttgggggaaggattgggttatagctactatgtatacttgctgcaacttgtcagggtcttttatttagaagaactggctaccttttcaatcagtgggctccgagtctgagaattgcctcagttctagaacctgcataaggcatcgtgatagttttattgcagcagtaaaagtcttgttcaatgcccatatctctttttcttcaggagtaaattggaatatgagccataaccacagatctatgcaggacctgcgattgctgttgttttggtaattatgtcgtccttatttctgatggccaaatattgccatcggaataccgctatgcttgaatcttatcaacaccattaagactgggaattccacttctctggcactatctccaaccatcaactctgcacctactatagatgacaggcaccactgaactctgcccccctcactagcatgttgcactttagtaaagggaaggttctactcctcgtgggaaaaaaagttagtgggtagattcctcagtattatatggcatgcccacctcccgcatcttctcgcctcttgatctcttccctaaatactgtgacaagacaattctggaatttccacctcttttcttttctttcgttctcctcccctcccctcccctccctcttccccttccccctcccctcccctcactccccacctttctttctttctgtctttctttctttctttttctttctttctttcctttctttctttttctttctttctctctgtcccttcctctttctttctttctttctctctctctctctctttctttctttcttcttttcttttgcaggtatcttgctctatcacccaggctggaatacagtggcacactcgtagctcactgcagccttcacctctggggctgaagttatcctcccatctcagcctccctagtatctgggactacaagtgtgtgccaccacacctcgctaagttttgtattttttgtagagacagggtattgcaatgttgtccaggctgttctcaaactcctgggcttaagccatccaacagccttagactcccaaagtgctgggattataggtgtgagccgccgtgcctggccccacctcattttctataggctgtttttatttactggttttaagcagctgtcctggtagtgtattaagtgttaggtgttcttgtcaggatactaaatccttaggcaggcaagagtgctcccatgtcaataaactctccattttctagccttaaattctggcctcgtggctcagcacccttgagttccaatataatgtatgttctcatagttcctcctagtatatattaatcagatccttcagttcttttggtgagtaatctttttccacttatattagggacctttccagtttggacccagacttgatccaagttatcagtctagaagccatgaggaaaagaggggaaggtattgaggaagatgtcatttcagggttatcgggagcatctactgagatatacccatcctaaatctcatgactcaaatctctccctcaccttcatttttaaccaaatcctgtatttcagataggaactttccagaactgtgaatgtagcctttattactctgttatttgcacaaacaggccctaaacaagattttccatccagtctgcatctgcttctagaagatgagggtattgtcaagtgctgttatagatgccttctcacagtcacactgagccctcaattgacagttggctgatctgagcctactgcttttgctttcttaaaggcattcatcccatttaatcaccaacaccacagtccttatagttgccatcgcaatgaaaatccaatgatattatgtaagctattatatccctttctacctgtattaaatgccaactcaccacagttgagactgttattaattgttatactgcagttgtcagaagttatcacctttctaccctcaaccagaaatgagttacttgttgccatctacccagaaagaaatctaatcacagaatcccatcccaaggatgtgctttctaaaatctcttttggtactaatcctcttagtttggttcctccagaagccatagaacaatgttctcacaatcaaactaatgatgatattattatagtaatgtttgccttcaaacattagcaaagacatatctgtatagcacatggacttaatacttcttcagtatgagatgaatttatgctgcagctttcacactatttcaccttatccttctccacaccacgtttgttttagtccgttttgtgttgctctaacagaataccatagactgggtaatttataaataaaataaatgtatttcttatagttcttgaggctagaaagttgaggggcccatatctggcaagtgccttcttgctgcgtcatcccatgggggaaagtgtaagggcataaaagtgcacacgagagagtgagaggaagtgggcaaccttcatcctttcatcaggaacccagtcctgggataacagccttcatccattcacgagggcagatccttcgtggcctaaacatatcttaacagtcccacctcttaacactgtcacaattgcattaaatttcaacatgagttttggaaagaacattcaaaccatagcaatacacaaatagaccttaatatttatgcatattcttcttccttaattttacatgacaagaaaattttcatcctataaaagttcattctcagaatgatgtaagtaaggtggtagactaggaagctacaagctctccttcccctagaggggaaccaagttaaaaaatttatatatggaccagaatgcctctagaaaactctagaaagcaaatgaaaagctaaagcacctaagtcattataaagctgagaagggattccagtaaaagaggtaaggaaaatttgtggcatttggcatgcctatatgtgccgctccccctgtgaagcacagcctggagcaactgggagaaacccctcataccagggcttttccttaggacagaagcaaaagaatggaccatgtgtgcaatgtcctggtttgtatggagactacccaagggcctggcttctgtctcaccttatttgcagtagtaccaggaccagtttcagagtttggaagccactgaaaacagaggtgagcagaacatagtaaaatgtagaagaaatagataaattcctagaaacaaaatctaccaaaaatgaatcatgaagaaatagaaaagctgaacagaccaaaaacaaataagaatattgaatcactaattaaaagcctttcaacaaagaaaagctctaaaccaaatagcttcactggaggatcctaccaaatatttaaagaagaattaacacaaatccttctgaaatgctttaaaaacagttagagaagagggaacacttccaagctcattctctgaggccagcattaccctgaatcaaaaggcagataaaaacatcattaaaaaaaactatagaccaatatccctgatgaatgttgatgaaaaagtcctcacagaatactaacaaaccaaattcaataacacatgaagataataatataccataaccaagtgggatttattttttgaatgtaagtttggttaaacatcaaaataatcaatataatacaccatattagtggcagaaagaataaatagcacatgatcacaattgacaaagaaagaacatttgataatatccaacaccatttcatgaaaagacatgcaacaaactaggaagagaaaaaatgacctcagcataatgaggataatttataaaaaatcagagctaacattacatccagtgacgaaagactgaaagttcttcctctaatatctaggatactgtgagaatgttcactctgcaacatgttattcaaagtcctagccagagcaattaggctagaaaaaagaaatagaaggcattcaaattataaaaagtaaaattatctctattcacagatgacatgatcatatcaagtaagaaaaccttcaatgttcttcaaaaaaagtatcagaactaataaattaattcagcaatattgaataatacaaaatcaacatacaaaaatcagttgcatttctatacactagcaacaaacaattggaaataaaattaagacagcaaccccatttataatagcatcaaaaataataaaatatttagaaataaacaatcaaggagacaggaaatttgtcactggaaaccagaaaacattgctgaaaaaaattaaagaagacacacacaaaatgaaagacatgttcatgaattggaaaatttaatatcattaaaatacccatactactcaaagcagtctgcacattcaacacagtccctaccaaaataccaataacaatttttccaaagtagaaaaattcatcctaaaatttatttgaaatcccaaggaactcttactagccaaaaaattttgaaaaagaattctaaaattaaaggacttacatgtcttaattttaaactatattatgaaactctggtaatcaaaacagtgtggtactggcataaaaacagattagaccaacagaataaaatagaaaggacagaaataaacatgtgtataaatgactacatgattaatgacaagggtggcaagaccactaatggggaaagcacagtttttttccaaaaagctctcttggaaaaactggttatctacatatgcaagaataaagtttgaccctattttacaccatgtacagaaattaactcaagatgaattaaagggtcaaacataagacttaaaactataaaactcttaaaagaaaacataggatatagttttaaagacattgtacttggcaattatttcttcaatatgacaccaaaagcacaggtaacaaaagaaaaaatagataaatggggctagataaatcaaaaaaacttttgtacatcaaaggaaacaacagagtgacaggcaacttacagaatgggagaaaatatttcaatatttttgcaaatatatctggtaagtggttgatatacagaatatatatgaactcatataacttaacaacaacaacaaaaatcaagtaaaccaattagaaattgattagaggtcttgaataggcatttctccaaagatgatatacaaatggacaacaagcatatgaatagatgttcaacatcactaatcatcagaggagtgcaaactagaaccacactgagagattatctaataactattagaatgactaacattaaaaaaagaaacaaaaaaaagtgttgacaaggatgtagagaaattggaaattctatgcagtttgtgggattgtaaatggtacaactgatgtaaaaaacaatatggagtttcctttaaaaatttaaagtagaactactatatgacccagcaatccctcttctgtgtatatattcaaaagatttgaaaaagggtctcaaagataattttcacatctatgttcatagttgcactattcacaacagccaagagatgaaagcgacccaaatgttcgttaacagattaatgcaaaatatatatacacaattgaatagcatatatatacacacacaattggatatcattcatccttaaaactaaaaagaattctgtcacatgctacagcatgaataaatcttaaagacattatgataagtaaaataaaccagtcacaaaagaaaaatactgcatgattccaattatatgagatacgtatgatggtaaaattcatagagacagaaagcagaataatagttaaaagggtattgagagaggttgtgaaaggagacttattatttaatggatgtagaatttcaaatgtgcaagatgaaaaaatgctggagatgtttcacaacaatgagaatatagttaacattactaaactgtacacttaaaaatggttaagatgtaaattttatgttatgcgctttttatcacaataaaaaaagtaatttaaaaatctgggaatatggaaatagaaaaaattctgcctgccataccagccatttacagctttctgaaagtgtatacctacccctattctgctttttatttacatagtcattactacatatttactttcttccttactcatgaattttttccctcttgagaaaggttttataaagggatcatatgcaaagctattagcaaggtttatacaaagaaaacaaaggatggcacagtacccaagactagtaaaagggagcaagtgaagagaaagggttatccaacctggccagggacctaagtgatgagggccagagggcaggtactttggcttccaatagagggacacagcccagtcttgtggcacctagcagagactaagccaggaaatacctcctgtccatgccaactcaagcaggaaatcacagagaaaggggtgtggctgggtgttgaaatccatgtagttagcctcctggggccttggcaagtgtgaagaatagaagaaagtggatctgagggggtcaataagaatatacccagtacaacgtactcctatctgatttctgattgctgttcttagtactcttccttttagtgtctaaagtgatctgcttaaagggcaaaatggattataccagttgcctgcttaaaagacagccaccaatggcttcctactggatttgaaataaaacccaaagccctttttgtggcctactaggcccagaacagtttggttactgcctccctctccaactggatttcaattcacttcctctcatgctcactgcatggataccaccttgtccttcttttagttccactaacacagcaaccatgtgtctggaacactctgccctgcagctttacctgctctgcccatagctgaatccttctcaccctgtaggtttcaacattaatacagactccccagaaaggactttgattattctatcttatgtaggtccagctaaccctgtttgttatctactactatagcattttgttggctgactaaattacttctaacccaattgcctgttactttgtttgtatgcttatttattttcatctcccccactgtaaactccgtgcagttgggaatcatggttacctttttcactgttacaccattatggtcttgcaaaatgtccgatacagtcgggactcactaatacagttaaattaataattatgttagtaagtaaataaagagtggcacacttttacaaagtttctcagtctgctgcttaataactggctcaggtggattccaaatttgtaaccttgacctcgttagcaccacatgccaactgattgattctgaagcatgatttggagtccctgcaaaagaaatgctctggtagcttagctacaaaaactcccttcgcctccttgctgtaggagtaaaaggagggtggaatcatgtgagtgatgaagggtggaactgctcagagctgtgaaagatacagtgataagctgtgtgtgctgatagttcatttaactcatcacctccttgagttgaaaaaaaaaaaagaaaaggatttgaagtcttcatagctggtgagtcaccttctcctccttcaaactgtctgacaaaaagaacaccaatttccttgtagatttatggcttataatcttcctctttttcaggctgcagaagaataggctattcataagattctagagaatttaaagccaattaaatatttttttgaatacttgaagagttctccctgacccagggtcttctagggattatcagatgtaaaaggaaggtagaatttaattacaaattttctaaggggtaacaatgtgcaaatggaataccgatagtgcaagtaatctacatctgcaaatgtaaagtcagaggaccccatatttcagggaaaaaaatcagtcttctttagcaggtaaagaaagcatctgtaacaatgatcaagtgcctgctgagaataaaagcctcttgtcatgattgcagaaggtgatgcttgctttccagaaagtcaatttcctctctctctctctctctctctctctctctctctgtgtgtgtgtgtgtgtgtgtatgtgtttgtctctttgtctcactgctctctttctgaataatatcttcttctaacaaccactcccgaaggtgtgcaacttcacaggctgttgatgatatcatattgcctatactaaactgttaggcagttttccaaatagttaaaaagttaaaaatgttttaatttgtttttgtccttaaaaactccctcaaaccactatattttaaagatgccagaggagatagtgctgagcaattcagaaagcaaaacgaagcaaaccaaaacaaaactttgggtcagtgatgccagttacttaacaccctcaccctcaatgcagagccggcagctaacgtgcttttccagcttcttggtggtcttaattggttccggagaaagactaactgtccatatacacgcaaccagctgatcgctccagctattatagacttttttcagtaaatgagtccaaagtgattaagtctacagagccatcagattcactgcattctatttctgacatagaattttaaaaaaaatttatagggaaaacaaatgtattgacatttacaaaaatcagtttaaaattgaatgggaatcactgaataaaataaagtgcttaaagtcacagttgctatcatatttgttctcactttcattaaggttctgaaataacttttcttttttttctttttctttttctttttttttttttcttttgagatggagtctcacactgttgcccaggctggagtgcagtggcacaatcttggctcactgcaacctccgcctcccaggttcaagtgattctccttgcctcagcctcccaagtagctgagattacaggcacccaccaccacgcccagctaaattttttgtacttttagtagagatgggatttcactatgttagccaggctggtctcgaactcctgacctcatgatccgcccacctcggcctcccaaagtgctgggattacaggtatgagccaccacacccagccctgaaataacttttgtacagtaagtattgaaggaaattaatcatatctttgcaaggaatttgatagagcatttagaaaggagaatgaggccaggcgcggtggctcacgcctgtaatcccagcactttgagaggccaaggtgggcggatcacttgaggtcaggaatttgagaccagcgtggccaacatagtgaaacctcgtctccgctaaaaatacaaaaattagccaggtgtggtggtgcacacctgtattcctagcaactcgtgaggctgaggcaggagaattgcttgaacccaggaggcagaggttgctgtgagccaatatcgtgccactgcactccagcctgggtgacagagtgagagagactgtcaaaaaaaagaaagaaagaaagaaagaattaatgagaataattttttctataattaaccaaagaggtaagttctaaaaaagtatttgtttttccacccctaaattttggcaactataaataaatgagcaaagagctttccttcattattattctttttgttgataaaggtggaagaagtagttgaagccaaattctctgagtgacttaaaaagataatattttgtagaggttgcaaaggttatgaaagtgtcagttctaattttttaaatgaatcacacatccagaagttgatgcagaaaattaacctcatcatgtattttataaagttctatgaggaaaaatacattggttacttgttaccaaaaatttccaacgaaagttttataaatcaggaaaaccctagagcgtatcatgaattgtatgtatgagttaatcagtgtcaagaactttgaagggtatgagaatttaaactaattgcagctaaccagttctgctgccagtttcattgctagcagaagacacaagactccagattagagacaagttattcacattgcagaaagcagcacgagggtagcatatttgtattggttctttttgctccccacattacatgggggtgatgctgatggatccaggtgtatgttgcacatgcatatgtttgcatcatacaacaaaaccagaatcttttacaaagggcaaaaggaaacctgtcctttttcctggaaggagaaattatctttactacaccaaatgataagtaaaactgctcattgctcctgatgaagacactacatttttcaagattgttcactgtacagacatctttgaaaagacagtctagagaaaaagggcaattattgcttgaaacatgttttgaaacaccggaggcttatggaaaagtttctctcaataatcaggtgcaggctaatcttaaaaataactacggccggacgtggtggctcacggctgtaatcccagcactttggaaggtcaaggcgggcagatcacctgaggtcaggagttccagaccagcctgcccaacatggcgaaaccccatctctactgaaaatacaaaaattagccaggcgtggtggtgggcacctgtaatttcagctacttgggaggctgaggcaagagaattgcttgaacctgggagaggaggttgcagtgagcccagatcatgccattgcactccagcctgggtgacagagcaagactctgtctccaaaacaaaacaaaacaaaacaaaacaaaacaaaacaaaactatttaggtaacttactattgtattaaatataacatagattttccgtggacattttaccccttttaaatcatatcttttttttattttttatttttttgagacggagtctcgctctgttgcccaggctggagtgcagtggcaccatcttggctcactgcaagctccacctcctgggttcatgccattctcctgcctcagcctcctgagtagctgggactacaggtgcccaccaccttacccagctaattttttgtatatttagtagagatggggtttcacgtgttagccaggatggtctcgatctcctgaccttgtgttccgcctgccttggcctcccaaagtgctgggattacaggcgtgagccaccatggccagccttaaatcatatcttaagtgaatgataaagagacagtctcattctatgactgtgccagtagtaaaaataggattgtccattcctaataaattcattgtattttattattaactattatttggttctaaacatcaaagaaatgcattggatcagtgggtaaataaatagttgttatgattactccagtgtttagtactgggacagtttccagaatctcttgatagttcttataatcaaaagacctttgataccagtgtgttgatctaaaagacagctaatttgcagcctcccagcataactttttttaataggtcctcccatataacctatcttaaggtcaattgattcagtagaacacctagattggggtacaaacaactggaagaagcgttattagctaggggtcccaatccagacgccaagagaggattctggaacctcatgcaagaaagaattcagggtgagtccatagattaaaatgaaagcaagtttatcaagaggcaggagaatctcttgaaccaaggaggtggaggttgcagtgaaccgagatggcaccactgcactccagcctgggcaacagagtgtgactctgtctcaaaaaagtaaaaataaaagaaagtaaaggaataaagaatggttactccacaggcagagcagccacatgggctgctccactgagtatacttatagttatttcttgattttatatgctaaaaaagagatggattattcatgagttttcggggaaaggagcagggatttcccagaactcagggttcttcccgtttttaggctatatagggtaacttcctcatgttgccatggcatttgtaaactgccatggtgctggtaggagtgtctcttagcatgctaatgcattgtaattagcatataatgagcagtgaggacaaccagacttctttctcatcaccatcttggttttggtgggttttggccagcttcttaaccacatcctgttttatcagcaaggtctttgtgccaacctcccatctcatcctgtgactaagaatgcctaacctcctgggaatgcagcccagcatatctcagccttattttacccagaccttattcaagatggaggtgctctggttcaaatgcctctgataaaaggtgtcctcaagtggctggcaattttggaggccatctcaaaaattctgcctaccataccggccatttacagctttctgaaagtgtatacctacccctattctgctttttatttacatagttatcaccacatatttactttcttctttactcatgaattttttccctctgtagaagggaaaatttttctttttagcccagaggtaagagagtgtgcaagtgctatgctatctactccctataccctagaagcataaactttagcaagtcagctacatcccagtaaaattgctaactacatgtatctataaaacagataatgctaccatctggaccctattaccaacatttgaaataacaatcccagggactatccaatcctggggactataccaacagaccataaggcaaggaaaagtggttccttttcatgaattactgttagatgagcacacttaaaagaaactataaacactgagcctcacaaagttcccctactaacctccatcccttgaagtcagtcaaggcagagtcccctagagttgacaattaaaggacagaccatggtttttctcagagaaaaccatctgtccaggggtaaattgacctaagcctgttgtttagacaccgtggaagtaatggtagcaaccaaaacgtttgcatagatgaggcttctcaacagcctcacagacatagagaattataatgaaagcaagtctcacataaatttttccatgcatacatatgtatgaaatttcatgaatctgggaaaaaacagttcatgcaatgttttctgtaatcttggatgaagtgtgaactctctatttttgtgagaggttcaatcttactttgcataaaatatcactggatgctggctccaatattctaaaggtagatcctgttacccctgtcgtcagaaatctccaattcagtggctagacacaaaaccatttggtgatccctgcttgggtccccttcctatggttacagactataagacttattcaagtctcatactctgttcatgcaaggtaggtattttcttaaaaagtttagttaatcctcatatattgaatgctagttatatcaagagagaattcagctataactatgctgattagtaagacactgatttcaccaatgaaaatccatttttagaaaatttattaacataattattaaagcctttggtgttagtcaaagataaaaataatggaaacacttgtagttgctttgtctggagtgtaggctttccaatatgtaaccagtcctacaatctaatagactgttgacctattaatttctgaatgaagtaactgactgcatctaaggcctaactttaacatactcatgcagattacactctctaaacaaaagtattttaaaataagtcacagctatcttataactactgtttaggcaccttgtagtcaaacaggctactttcatctctgaaatggctgaaaggcctagtgcctagggtcaagttcaccagggtgtaccacacaactttttcagtaatttccctatctcccattttccatctgccacagacctataggtaagccctactcacttcagccctcctcatatctgggagacatcttgcccttttccctccacctgttttcaaggcttttttctttattcgcttttgtattccaagagactttatttgcacataatggaagacaagtggcttccaaggcaaggaaaaaaagggtcctagatattttaataggtaagagaaagaaatgaaatacaacaaacaaaataaaaactaataaatcaaattatgtcaaaaaataatttttttattggagaaggaagttgaaattgtacctttggttttggcaactaacaatgtgttattttctttcctgaccaggagagaaaataacaacctgtgctaggacttgacctgcaggcacctgaaccaaaatggaatccaggcgaagaaaacagggctgggaagtcacaatattttgaactttctcatactagtattggtacagttttcacaaggaactttaggagaagcctctgtgctaacccagcagagttatcctctccccatgtgtcctctctacttactcatcattactatgccaaaaggactatgtagtcatacctgaaaaatgtttagttaataaagctaggtgttcaatttacaacaggacctctagggaaagacaaatgtagcctcctcttatccatccaacaggcaaattcttactaactttttatgtctcaacttacatactaattccttgaaaaagccctttcctacttgcctggaacttttctgcagccatgctactgctgtatctacacatactccttagcatagaataaacctaaatatcttataattaattgctcatctgttgttcagataaatggtttttatctttgtattcataatctctagttcagtgtctagcacatactatgcactagaaatgtgagtttaatgaacaattgcttgactagcagaaaagttccatgactcaatgggagaagatgactcaaaggcagatgaacatgcctttagggaatagaagaaagaacaacttttcttctaaaactggtaataagaaagaatacaaagcagataaaaataagattgtaggtgtgggcatagaaagttaaaaaataatttactccttttttttaattgcaaaataaaagacacactggatggaggaaggtattaggaatgggtagaaactttagaagtgtagtataggtttggaatagttattgagagaaatgaaaaaagacacggctaagaacacaaaaaggaatttctcaatgacgttgagaacctgactgcagctgcataccatttattttaaaaatgacaatgcaacagtattcaaccgcttggggcaggcaaaaagatactgaccactcagttaaatgaatattgttacaagtagataaaagatcacaacctacatacttaaaaatatgttcatcaaatgataatttcctacattgtctattcagagttcatgggcagcttactagataatgtaagtaattaatacttaagagtttctctagtaacaggcatctagtgctctatcagaagccatgatttttgaaaaatatataaggatagcatgagggagatctaatagtgaaacagaagacagtctacagtggtgcagaaactctagctcctagagaggcgactccaaaggatggtatgcaaaacagcttttgtcctaaaagtgatatgaattgaaattttataacaaatactagagttgggtcattatcacatttttttttataaaacttgataaatatggtgttattttgcataactttggaatatttcactttagaaatgtgaaatttttatcaggaaataaaacattttccacacctcttcatgctagaaaaatgttattgataagagttaaaaatagttttgtttctctctttacctaagaaggaagtaaccaaggagagtatttttaaaattgcaaacagctggataatcaacaccaagttcctatctcttgcgtaggttgcaaattgaaaaatgaaatcttgtcttgtttgcagatccttaaaagagggtctgaaagtgatttagtttcatcactaaatatttatggaaattgattaaatgttaccagggacttacagagatattaacaacccccagagcaaaacaagatctttcttccgttactgtgttccaagaaatttgaaaatatgctacatatgttttttctggaacagtaattgaagaaagaatcaatcaatgaattaaaaattattttccataacctgtcctctaactattttctttattttagcctcgtattatctactactgagctacatttacaatatacacactagagactatcattttggcaaatgcataatatgttttattttactaagcaaggtattatgaaaggaaaaacattaaatctcctctgttttttattaagcatgtatttctccattcacagtgttttactctggacaagaacttaataaaatgagaagtccaaactcatgtttctctttactatagaaagtaatttgttggcctcatagtttaacctgtccaagataaaaagagagtctccagtaaatacttccacttaatgatgtaaaatttttattcacacagaatttctaatccatatatgtatacaaaataattacatgaaggaaatgtgagcaattacttcaatcaaatccttaaaaaagaagcatgatactcacctaaccagcacagtatacaatatctccccaaattggaaagcattttcatgcagaattaacagaggatggcccatttccatgcatcagcagcagtcttacacaactatccacacccaagatctcacacactcacagggaaggaatcatctctttcctttcctaatgtcacccacagtagaaccatatcccttctccactctttcttagcttgcacaaaaataattcccaccacccacaggttggctcagggcctctgaggaatgagcagtgacaagatcaaagagctcttcctcttctcacacccacagttaattgtctacctccaagattctaaacttgaaggcacgtctcataacaccccaaaggggaggattgcgtgagaagacagcctgccaactcacacggtattatgaacccaaacagaccagaataaaaaatacacacccttaatcaatcacttataacaattaaaatgtgctgtagtttccttttttcataatggcagtctgtccagtttatcagtgtaaatatatttacatattaagaggatcttggaatttctgcacttgctgagtgacataatcaacagcaagtaggtaagttgctaggccaaaagaccagaattatacagaatacgtgctttgtactaaaataattgttctgatggggaaattataatttattcccaagtaattgtatatccttgtagtcagagggcataagagttgtaggtacacaatttgagcagggttatggtgataatagtaataattgctaacatttatcagtggtcatctatgtgttagaaatgtactggattatttatatacataattcctaattaataacataaataaggttactagcctagtaactgactgagctaccttgtctagtgaatggcctgaactaatataactgtatgtgtctattactgtaaacctctgtgctcattcttagaccagcaatcgtaagtctcaggccttcattacacatttaagccttatagagaatcccaaagagttttgtctatgtgggggtgcatctatcaatatatgttaggaatttaaaatgagaaaactttaaaatgttttgtacattaaatcattttaaagaagaatactaaatttatttcatgttaacgtaagtaaaatattttatgaaaataatgttttccaaaacaaaaaaaaagggagaagaatggtactgctttacatttttgtaaatctcattaatctgtggcttaatagaagataggtatgctctgaaatgtgctctgtatttgatgtgttttggttgaaatgtaagaagaaactatagccctacacagatacataatagaaagatgaaagaatattttaatagcattttcaggtaattatgatattattattggataccacaccaaactctacaaatagtagtttctcacagattaattgtaatgtgttctctgaaattatatcagtaaaaagtgtaccctgttatatcaaaatcctttggtccatgtttcatgttgataaatttgttgacacataaatgcttttttaatatcatgcattagtcattgggaaattattagttcaatgaataatgcagatagtccaaatgttgacactttttaatataagattaaacataatatactttgattcttttctctttatcttttgtgtatatattagaggttttatccctatgtttactatctggcttacataaaacaccagatagttatatcattatattttaagctgataacaccttaacttcaatcacataaaataccccgtacttttatttttctaaccttccactcttaatggtattaatatcacacttaacatgtttctatactgtgtatacatctaaaagttattgttgttatagctatttataatatttttgtcttttaacttttatattagtgttaaaagtgatttacacaacagcattacagtattagactatgcatttccctttaccaataaattttatacttgtacatgttttcatgttgtcacttactgtcctttcatttcaactcaaagaactccctttagcacttcttgtaagacagagctcttcgtgatgaacttcctcaccctttgttttctgggattatctttatctgctcttcatttctaaagggcagctttgctgggtatagtgttgttggttagcttattcttgaaaggttttcttctttcagcactttgaatacatcatcccactgtctcctggcttgtaaggtttctgttgagaagtccactcatagcctaatgaagattccctagtataagtctctttttgcttgttatttcaagattctctctttttgaaaattctatcataatgtgtagctgagcatttttctttgagttgatatttcctgggatcctttgagcttcatgaatctggatgtccatattccaggcccctcttgttgaaaactgggaagttttcaaccagtagttctttaaataagctttctgttcctgttttttttaattctcattctaggattattataatttgcatatttgttagcttgagggtgtccataggtatcatatgttttctttactattttatattcttttttctttttgttactttaactggtcaatttcatatgacctgtcttcaagtttaataatcttttcttctacataatcaggtttgctgtcatagttctcaactgattttttcagttctgtcattgtattcttcagctccaggatttttgtttggttcttttttatgctttctaccctattttttaacttttcattttgttcatgccttgttttcctaagtttatttagttgtctttctgtgttttattgcatctcattgagtcattctgagatgactattttgtattttttttcaggcagtttataggtattcatttatttgtggtcagttactgaagctttatcatcaggttgtcatgtttcctgattcttcattatccatgtatacttgtgctggtgtctgtgcttttgaagaagtaaatacctcttccagtcagtctttaagactggattaggcagatgaagagcttctcctgttgagttccaagctgattagactgcctccagaattacggttgagtgggagtgaagctgggccatgtggctactacttggtccacaatggcattcatggttgatgaacctattaccgggggcttgcttgagtgggtatgggtcttgtctggtctctcaatggactggactgcctcaaggcccttgatcaatagatctgggatgagggtacacttcaggatccacagtcagtggaccagtcaccaggtgcatggacacatatggctttgtccaaatccctgggagagctgccacttggtgtgtccctgggaaggcagtacttgccctggacttcatctgagaggagctagagactgcttcagggcctgcagcagagaccaaggccacaactgagaggagctagagctgagttacagggctgttttaagattcacagtaggactgaggagtacggcgggcctccctgcagaagcataattgggtatacttccctttggatatctttgcaggctgaactggtctcaaactgcagctggcagggattggagccacattatagggcctcttcaaaatatgctacttgactgaggctggctaacctacctataggggcatgggtgtgtatgtttctcggtgggtccctgggcaggcaggactgctctcagaccatagctgaaaggggccagaactgagttagaaggtccttttagggtccacaactgggaacagggttgacaggcctgttacctgagggatgtgtgggcattactccttcaggttctttggtggatggttctgttggtagaaccaaagccatatggacagacccatttctgagtctggtgagcctgctgactaggtgtaggtctgccctcttgaaatagccctcctagttattgggctccattggggtttcacaaccttgaacctgcaatttttatgacatcactttcttttcttttttaaactcaagattattttcatttgaattaaacatggcaaagtatttaaattcctggtggtgttaggccacaggatgctatatatttgctatctgtgtggtcccagttgatataataaaagaggtaaaagctggtaaagggttggtgctctatttttttttttttttttttttttttgatgcatcaggatgcacttccaattcccggatttacacaaatgctctaattttagacagacctgtgctgtttaacatggtagtcagtaggtacaggagaacattgagcactgaaatgtggctagtctgaatttaagatgtgctgtaagcataaaatacccaaaagattttgaagacaaaaaattatatagagtatctcagtaacattttatactgattatatatgtcaaaatgatcacatttggcatatattgagcaaaataggatatattattaagattaatttcacctgattctttttactttttaatgtggctgctaaaaaacttaaaacttcatatgtgacttgaatttggcttgcattgtatttctttttcccttttttttttttttttctgagatggagtcttgcactgtcacccaggcttgagtgcactggcatgatctcggctcactgcaacctccacctcctgggttcaagcaattctcctgcctcagcctcccaagctgctggatttacaggtgcccatcaccacgcccagctaattttttgtatttttagtagagacagggtttcactatgttggccaggctggtctcaaactcctgaccttgtgatctgcctgccgtggctccccaaagtgctgggattacagatgtgagccactgcacccggcttgcattgtatttctattgaatagtgttgctttagccattggcaagaatgagactaaatcaattccatattagcctgggaccatattttgtttgatcatttttattaactcatactacagctctgtcactttatttttatggaagaattttaccattggtcactgtagatagtgaccatgactacattacttccactagtgtgatttatttttccttttttaaaaaaactaaaaaaatacatatttttactattttaaccctctatttttttttgaagtagagtctctcactttgttgtccaggcatgagttcagtggcatgatcatgtctcactgcaacctcaaccacccaggctcaagcaatcccctgcctccacctctcgagtaggtgggactacaggtatgcaataccatgctcagctaagttttaaattttttgtagagatagggtctttttatgttgtccagtctggtcttgaactcctgggcttaagcgatcctcccccatcaacctcccaaattgctgggattatggtcatgatccactgtgcccagcctttgttttcttaggacatatacaatacacacactcacacacacacacacacacacacacacctttccaataagttgtagtagagaagagaaaaaaaacaaagaaacgtaataaccaatgccagaaatttctggtgactatagatttctttttcattcaatccattctaattggtcatagaatatttttatcaagaaacttaatcatgacctgagtttgttttatatcaaagattagtagaaatgacatatttagaaaacaaatttttatttatatttttccctgtaacatacattgtttgaataggatacatattcaaaatgttttctgtttctgcacagtaaagtctaagaaaagtgctgggaaatatatccaccttagaaatcaataaaaagatggatacctttttcaaatgtgtacaatatattctgtcttgtaaagttttttaagactatgtgaataaaaaggaatcatctaccggaaacctttagcatagtgccaaagtgcctgatgtcatagaaagcacttgaaaaaattaaaaaataaatatctttcctcaaagttttttatttctacatttatccatatctgctttttgatgtcaggaaactctctgcaattctctcactctgcttttttctggttaattttttttccttactctcacactgaagtacaagcaaacatttgatctttgtgataaacagtctcctttaattctacccctaagctcagagtttcatgttcctattctctgatgtgagttgtcccttaataatgtgtcatagtaaccatgaatatttgtgtaattagctttttagaaggaacacaaaaatcaaagatgatctaaaaaatgtgttttgtcatgctttgtaatggctagaaaatgttgtttggatggctgcaaattgcatgataaactttcaagcattttttaattgtttaaaaaaaaaacacgtggcaagttttaacatgttgtcatttttgaacaggatgtaaattacatcagtcacattaacaaatgaccatatggtcaggacttcagaagaaccagacaggagccaaacacccccaggcagagtggcataaaggaaatcagagtttgaatctcagagatatttaataacttctgtatcttattatatggtaaatttgacagacttggtaagacacactgactttcctacatacttaagaagtgagtccaggctgatgcatagatacagagaaatagcagaaattaagaccaagttgaacaagaagcaattggcaccagaaaatatgggtagggccaatacaaatatagagttggagaaagtgtttgtgggtattgaacattttttgtagtctttgtccaagatggctgaataagaacagctctggtctgcagcacccagcgagatcgacgcagaagactggtgatttctgcatttccaactgtggtaccaggttcatctcactgggactggttggacggtggctgtagcccacggagggtgaaccgaagcagggcggggcgtcacctcacccgggaagtgcaaggggtcaagggatttccctctcctagccatgtgaggctgtgacagactgtacctggaaaaatgggacacttccgcccaaatgctatgcttttcccatggtcttagcaactggcagaccaggagataccctcccatgcctggctcagtgggtcccatgcccatggagccttgctcactgttagcacagcagtctgagatcgacctgcaaggctgatgctgggtgtggggaggggcgtccactattgctgaggcttgagtaggtaaacaaagcagccaggaagctcgaactaggcaaagcccagtgcagctcagcaaggcctactgcctctatagactccactgctgtgggcagggcatagctgaacaaaaggcagcagaaacttctgcagatttaaacatccctgtctgacagcttggaagagagcagtggttctcccagtacagcatttaagctctgagaacagacagactgcctcctcaagtgggtcactgacccccatgtagcctaactgggagacacctcccagtaggggctgacagacacctcatacaggagggtgcccctctgggacaaagcttccaggggaagagtcaggcaacgatatttgctgttctgtaatatttgctgttctgcagcctccactggtgatacctgggcaaacggggtctgcagtggacctccagaaaactccaacagacctgcagctgagggacctgaatgttggaaggaaaactaacaaacagaaaggaacagcatcaacatcaacaaaaaggacatccacaccaaaactccatctgtaggtcacaaacatcaaagaccaaaggtagataaaaccacaaagatggggaaaaaccagagcagaaaagttgaaaattcaaaaaaccagagcacctcttctccaaaggattgcagctcctcaccagcaatggaacaaagctggatggagaatgactttgatgagttgacagaagtaggcttcagaaggtcggtaataacaaacttctctgagctaaacgagcgtgttctaacccatcacaaggaagctaaaagccttgaaaaaaggttagacaaatggctaactagaataaacagtgtaaagaagactttaaatgacctgatggagctgaaaaccatggcatgagaacttcatgatgcatgcacaagcttcaatagctgattcgataaagtgtaagaaagcatatcagtgattgaagatcaaattaatgaaataaagtgagaagacaagtttggaggaaaaaagagtaaaaagaaatgaacaaagcctccaagaaatatgcgactttgtgaaaagaccaaatctacattagattggtatacctgaaagtgacaaggagaatggaaccaagttagaaaacacttttcagaatattatcgaggagaacttccccaacctagcaaggcagaccaacattcaaattcaggaaatacagagaacaccacaaagatactcctcgagaagggcaattccaagacacataattgtcagattcaccaaggttgaaatgaaggaaaaaatgttaagggcagccagagagaaacgtcaggttacccacaaagggaagcctatcagactaacagcggatctcttggcagaaactctacaagccagaagagagtggggaccaatattcaacattcttaaagaaaagaattgttaacccagaatttcacatccagccaaactaagtttcataagtgaaggagaaataaaatcctttacagacaagcaaatgctgagagattctgtcaccaccaggcctgccttacaagagttcctgaaggaagcactaaacatggaaaggaacaaccggtaccagccactgcaaaaacatgccaattggtaaagaccatcgatgctatgaagaaactgcatcaattaatgggcaaaataaacagctgacatcataatgacagatcaaattcacacataacaatattaactttaaatgtaaatgggctaaatgctccaattaaaagacacagactggcaaattggataaagagtcaagacccatcagtgtgctgtattcaggagacccatctcacatgcagagacacacatacactcaaaataaagggatggaggaagatctaccaagcaaacggaaagcaaaaaaaaagcagaggttgcaatcctagtctctgataaaatagacttaaaaccaacaaagatcaaaagagacaaggccattacataatggtaaaaggatcaattcaacgagaagagctaactatcctaaatatatatgcacccaatacaggagcacccatattcataaagcaagtctttagagacctaaaaagagacttagactcctatacaataataatgggagactttaacacccaactatcaatattagacagatcaacgagacagaaggatatccaggacttgaacacagctctgcaccaagcagacctaatagacatctacagaactctccaccccaagtcaacagaatatacattcttctcagcaccacatcgcacttattttaaaattgaccacataattggaagtaaagcactcctcagcaaatgtaaaagaacagaaatcacaacaagctgtctctcagactacagtgcaatcaaactagaactcaagattaagaaactcactgaaaactctgaaaaccacacaactacatggaaactgaacaaccagctcttgaatgactactgggtaaataacaaaatgaaggcagaaataaagatgttttttgaaaccaatgagaacaaaaacacaatgtaccagaatctctgggacacatataaagcagtgttaagagggaaatttatagcactaaatgcccacaagagaaagcaggaaagatctaaaatcgataccctaacatcaaaattaaaagaactagggaagcaagagcaaacacattcaaaagctagcagaaggcaagaaataactaagatcagagcagaactgaaggagatagagacatcaaaaactactcaaaaaatcaatgaatctaggagctggttttctgaaaagatcaacagaattgatagactgctatcaagactcataaagaagaaaagagagaagaatcaaatagatgcaataaaaaatgataaaggggacatcaccaccaatcctacagaaatgcaaactaccatcagagaatactataaacacctctatgcaaataaactagaaaatacagaagaaatgcatacattcctggacacatgcaccatcccaagactaaaccaggaagaagttgaatctctgaatagaccaataacaagttctgaaattgaggcaataatcatagtctacaaaccaaaaaaagtccgtgaccagatggattcacagcccaattccaccagaggtacaaagaggagctggtaccattccttctgaaactattccaatcaatagaaaaagagggaatcctccctaactcattttatgaggccagaatcatcctgacaccaaagcctggcagagacacaacaaaaaaagagaattttagactaatatccctgatgaacattgatgtgaaaatcctcaataaaatactggcaaaccgaatccagcagcacaacaaaaagcttatccatcacgatcaagttggtttcatccctgggatgcaaagctggtttgacatacacaaatcaataaatgtaatacatcacataaacagatccaacaacaaaagccacattattatctcaatagatgcagaaaaggccttcaataaaattcaacaacacttcatgctaaaaactctcaataaactaggtattgatggaacgtatctcaaaataataagagctatttatgacaaacccacggcagagctatttatgacaaacccacggccaatatcatactgaatgggcaaaaactggaagcattccctttgaaaactggcacaagacaaggatgcccttgctcaccactcctattcaacatagtgttggaagttctgaccagagcaatcaggcaagagaaagaaataaagatattcaattaggaaaagaggaagtcaaattgtccctgtttgcagatgacatgattgtatatttagaaaaccccatcgtctcagcccaaaatctccttaagctgataagtaacttcagcaaagtctcaggatacaaaattaatgtgcaaaaatcacaagcacacaagcattcctatacaccaataacagacagaaagccaaatcatgagtgaactcccgttcaaaattgctacaaagagaataaaatacctgggaatccaacttacaggggatgtgaaggacctcttcaaggagaactacaaaccactgctcaatgaaataaaagaggacacaaacaaatggaagaacgttccatgctcatggataggaagaatcaatatcatgaatatggccgtactgcccaaggtaattgatagattcaatgccatctccatcaagctaccaattactctcttcacagaattggaaaaaactactttaaaattcatgtgggaccaaaaaagagcccacattgccaagacaatcctaagccaaaagaacaaagctggaggcatcacgctatctgacttcaaagtatactgcaaggctacagtaaccaatacagcatagtactggtaccaaaaaacatatatagaccaatggaacagaacagagtccatagaaataacaccacacatctacaaccatctgatctttgacaaacctgacaaaagcaagcaatgaggaaaggattccctatttaataaatggtgctgggaaaactggctagccatatgtagaaagctgaaactggatcccttccttacaccttatacaaaaatcaattcaagatggattaaggacttaaatggtagacctaaaaccataaaactctacaagaaaacctaggcaattccattcaggacataggcatgggcaaggacataatgactaaaataccaaaagcaatggcaacaaaagccaaaatagacaaatagaatctaattaaactaaagagcttctgcacagcaaaagaaactaccatcagagtgaacaggcaacctacagaatgggagaaaatttttgcaatctactcatctgagaaagggctaagaatctacaaagaacttaaacaaatttacaagaaaaaaacaacttcatcgaaatgtgggcaaaggatatgaacagacacgtctcaaaagaagacatttattgcagtcatcagacacattaaaaagtgctcattatcactggtcatcagagaaatgcaaatcaaaaccacaatgagacaccatctcatgccatttagaatggtgatcattaaaaagtcaggaaatagcagatgctggagaggatgtggagaaataggaatgcttttacactgtggatgggagcgtaaattagttcaaccattgtggaagacagtgttgtgattcctgaaggatctagaactagaaatatcatttgacccagcagtgtcattactgggtatacacccaaaggattataaatcatgctactaaaaggcacatgtacatgtatgtttattgcggcactactcacaatagcagagacttggaaccaacccaaatgtccatcagtgatagactggattaagaaaatgtggcgcatatacaccacggaatactatgcagtcataaaaaaggatcagttcatgtcctttgcagggacatggatgaagctggaaaccatcattctcagcaaactatcacaaggacagaaaaccaaacactgcatattctcactcataggtgggaactgaacaatgagaacacttggacacagggcggggaacatcacacaccagggcttgtcagggggtgggagacttggggagggatagcattaggagaaatacctaatgtaaatgaagagttgatgggtgcagcaaaccaacatggcacttgtatacctatgtaacaaacctgcatgttgtgcacatgtactctagaacttaaagcataacaaagaaagagaaagaaagagagagagagagaaaggaaagaaagaaagagagagaaagaaagaaagaaagagaaagaaagaaagagaaagaaagaaagaaagaaagaaagaaagaaagaaagaaagaaagaaagaaaaagaaagaaagaaaagaaggaaaggagggagggaggaaagaaggaagagagaaagaaagaaagaaagagaaagaaagaaagagagaaagaagggatggagggagggagggaaggaaggaaggaaggaaggaaagaaagaaagagaaagaaagaaagacagagagagaaagaaagaagggagggagggagggaaggaaggaaggaaggaaggaaggaaagaaagaaagaaagaaagaaagaaagaaagaaagaaagaaagaaagaaagaaagaaagaaaggagggaaggagggaaggagggagggagggagggagggaaggaaggaaggaaagacagaaaagaaagacaaaaagaaagaaagaaaaaagaaggaaagagagaaagagagaaagaaagaattttttgttgattggtacttcattataaaacatcacaccttaaattttagtttttttttatgttctttatgtcttctcagaatatactagatttctcattgttcaacttagaaataatgtatgtgtacatgtattccatatcacacacattcccagctctatattaatcctagttagcgctcaatatagtgccaatctgacatgcctagacatattactctttcctcaatcttatgccataaatatatgcattcttaactgctcgatgctttgggaattttctatgagtactcaactctgtgaagtttctcaaagcattccacaaatgagaaactgtccagtattagaggcatatatttcaatttgattactgtttaccaaatgctcacaggagcctggctttgtatgagaacgtattgcaaatgcccccacactgctgtgtatcatgtgtctttaccaagcttcaggcgccaggggctagacagacttagaaatcgttccttatcaattagtcaaagtgactgtgaaggcacttttacaattttggttccttacaatttgattcttataatgttatgccttaaattaagaagtattttttcatagaataaacttgaaaatatgctctagattatttttatatgctttcatgtgctgaaattataatattactttatttttattttgggcaattatttctaaaataatattttgcttattcaaaatagacaagttttaatttgaaacataacacaataaattagagaactgtaatggtgtcaagcaccaaaaacataatgaaaaaatgtgtcaagacaagttattctttagactatcaattagttacattcttgatgatgtgtcttcattttattaatatcctagaagtatttttattttagtgatatagaaaaaaatataaacttgcttttacctaacttcattaggaatacctgtgacacttgagctggtatttaagaatatattattaaaaataattttacctagttcttttcactttttaatgtagctgctaaaaaacttaaaactttatatgtggttttgaatttggcttgcattatatttctattgaacaatgttgctttagccattggcaagaatgagactaaatcaactccatattagccagggattataattagtttgatcatctttattaactcatactacagtcctgtcactttatttttatgaccaattttgccatttgtcactgtagatagtgaccatggctacattacttccaccagtataatttctttttctttttttttaaactaaattttttaaaactattttaatcctctttttttttttttttttttttttttgagacagtctcactttatggtccaggcatgaggcagtggcatgatcatggctcaccgcaacctcaactgcccaggctcaagcaatcctcctgccttgatctcctgagtatctgggactacaggtatgggccacgatgcataaatgactaaaagctaagtcattttctacaagtaacacctgcaaagcagtttggaaaattattcagtaatgaaatttcattggacctacagagatttgttttagctacgttcacctttaattcgaccatttaacaactgcccttcccagtcatctatcatctaactaatctttcttacaagaggatcaaacaacagttgattcctatcacatttctcagtttttcttccatcaacttatatgtatactcagagaaaacattatttgggccgggtgcggtgcctcacgcctgtaatcccagcactttgggaggccaaggcaggcagatcacgaggtcaggaattcaagaccagcctagccaatatggtgaaaccccatctctactaaaaatacaaaaagttagctgggtgtggtggcgcgtgcctgtagtcccagctacttgggcggccgaggcagaagaatcacttgaacccaggacgcggaggttgcagtgagctgagattgcaccactgctctccagcctgggcgacagagggagactccgtctcagaaaaaaaaaaaaaaagaagaagaagaagaaaaaggaaacatgatttggaaggagtgataacatatatttcataccttacttctcaatgctgagctctcattatagttttagtctttgggagagtttaaatcttaactgttagcttttaatgatttaaagagattgttatgcaattcgaaatattatgaccaagtattattatattctgctgtgtaataaaccaccttagaatttgatagcttaaatcaagtaaaatagtttactttgctcatgaatgcacattttgggcagtgctctttgatgactctatgtctctgtgctgcatagtgtcacctggaaaggagctgaaggatccacttccaaagttgctcagaaggaaatgacatttccttcccatgagagcctctctatctttctcccagcagggcagataggtttcagaaatgagtgttccaggaggcctgggtagaagccataagtcttcttatgacctggcctcagacccactcccttctattggtcaaacaagtggctaaagcctgtctgatcccaggagaagcaaataagagctcaccctcttagtggaaggagtagcaaagaatttgtagttgtctataatctacccataagttattctgatgtcattatttgcccttacatcacatgtgatatcaaagacatttttggctatggtagtgtttgtattccgtaaaattctctgctctctctaattggactttgtctttaactgctctgcaacttcccaggtgtgaagaagctcagagcataatacacagaaatggattttcacttaagccagtcacaatctgtattgccgtcttccaccattccgatactaattaagtggaaggacaaatattatccaaaggagtccatacctggatattgtcatcaggaaatcttggcactaagagagagaaggatggcaagggaattgcagcagtcaccaatctctaatgtactagcatgtcctcaaactagtctgaaagagaggttggtttagatagcaagaatattcatcacacaggaaaggtaaacaccttggacacaagcttcctccaaatcctgactgacaggcagccagtctcatgggacaggggcgtgctcaggtcacatcagagacatatttgaacacacatcatggacaaatgctccaaaaagaactgtcctgtcatcttagccagttgacttaacatttaacaagcctattgcctttaacaaggtgatcttttaaaccatgtcccataattgacatggcttaaaagatattgactcgatataaaagatctccttgttaaaggcagtagacttgttaaaagcgaagtcaactggtttacttacattacatcaaatactgaggtttttcaccctgagaaaaaaattctaaatttatttttatatagctattactcaaaacctgttgtctagccacggtgaaaatctcctttctatgaggaaatgtaggcaacctgaagctctcataggatttcccctacaagctacataaaaacatatttcctcctctttctccactcagcaccttaaagcagagaagttgctaggtttcagcttcagccttcttttctcccactacttgctttccctgaagggtttcatttattccagaaacttcaactgtcacctctacattgatggcctgagaatctgtatctcagtctccatcctctctctcatatcttcctgtgtcatagtttttcctttgaatttcccttatctagttagtgtttcttagcttctcagaatcagcaggtccaaaactgaactcaatgtttcttatccccttctcttgaaaaactatttttactgttgtgattttcctgattagattatgggtataactatacccacatgagattcctaatggaagagatagcatcccgtggctcctccgtctctatctacttacatccaattgtcacctgagtttagtaatttacctcagaaattgccttaggctcagtagtcctaattctccaataattgctacttagtgccaatcttcatagctcatgcttggcccattgtaatgttcttaactacgtctactctctcctgacctttctcatccatcctcaacactgaaggtggcattatcatgctaatgtacacatcttactatatcaaccccatttcttaaaattctttttctgcaatgccgattaccttagcatacagtcatcccttgattcggaggattagttacaggacccctacaggtaccaaaatccatggatgctcaagccccttatataaaatggcatagcatttgcatagaacctacacacattctcctggatactttaactcatctctagattatttataacattgaatacaacatacattctaggtaaatacagttaggtgtcctttaatgacagggatacattctgggaaatgcatctttaggcaattttgactttgtgtggacatgataccatgtacttacacaaacactggtggtatagcctactacacaactagactacatggtactgcttatcgctactaggctacaaatctgtatacttgttactgcactgaatactacaggcaattgtaacacagtgataagtatttgtgtatctaaacatatataaacaaagaaaaggttaagtaaaaataagctactataaacttatgggaccaccattgtatatgcggtctgctgttaactggaacatcattatgtgacagtataatgactgtagttattatactgtattgttgtgttatttttgttgtttttttcctaatatttttgattcatgaaatccaagtctgtggaatctgcagatattgagggctgactctacccagccatgatagggacccgggataccttttagcttcatcatcatcttactcttcccttctccgaagctctggccaaaacaatcaactcacagctctcttaaagatacatacactttcacaattgggactttacacactttatctcctcattaacgcaatgcctttcttcctgccaactctaaaaaccccctctcatccctaaagaccaaactcaaaatatagtaggctttatgaaccatgacttgacagatagaattaatcattcccggttcctgttcccatggtactaaatagctccacaatggcactaaataatagcttccatatataagcttttcccactagattagacaaggatagtgttttattaatttttgtattcttatatcatcatgaaagacctgacgtatagtatgaactaagtgttcattgaatgagttagaaaatagcttagagatgatttagtcccacctctttcccaaagtttaaatatcatttactatatccctgggagatgtttattagtcaccacaccaacactaccagggtcagatagcctgatacttagaacgatgtaccatttcattattcaacctaacatttcaaatatttttttatgttaggcttaaattttgcctctgaatcttctataccctactcccattagtcctatttttaccctctgaaaaaaacttataataaaacaattttttatatggcaacatttcaatatttgaagatatctgctacaccatcctttgctgtctgttcataaatttaaccatttttaacccctgggagggggttacatctccttatatacatctccttatgtattttagtttattgaaatttccatatatatgtatatattattcagttcttaaagtgcaatgccagaaatagacccactcttccagttgcagttataccagggcacatacagtagaactatgttatgctgatccaaatgttgcacttcttgtaatttggctgctgattgtacacttgcaaaacttcttatctctctgtttctagtctcaatctccctcaatctttcataactgatgttgagccataatagaaccaactatttattctggccttgacctttaaagaatgctgagttgcccatcaatttgtgtcagtgtaaagctcatgtaagaattgaaggccagtttccaaatctcttatttactcagcctaacttgcaacttaccttaccatcatacttgttctcatcaccttactatgctttcccctggattttatattgcttccatatctacttcaagtcaaatttcttttgatggccacttttctaatgagctgaaaataactaccctgttactggtaccaatgctatttatccataatagatactgagcactgagcattagtttttttttttgtttttttgtttttttgtttttgagacggagtttcactcttgtcgctgaggctggagtgcaatggcatgatctcggctcactgcaacctccgcctccgagcttcaagcctcagcctcccgagtagctgagattacaggtgtgtgccaccacgcacagctaatttttgtattattagtagacacatggtttcaccatgttggctaagctggtctcgaactcctgacctcaggtgacccatctgccttggcctcccaaagtgctgggattgcagacgtgagccaccgcccctggcccacattagatactttctatgtgctggatcttatgataggtactttaaataaattatctggatttgaaaggaaaatttttataagagatacttaatcagaattgaggtaaacaccctacttaacatgtgagagtccagtcatgcctttttttgacaaatatttatctgtctttcattgttctccaggattcagaactcaaactcttctttatcttctaatttatactccctttaataagctacagccatttaatctgaaatcttgctttcattatttgcttccttgataggtagaatttatgtaatttttatatttccaggtttattaatgctgaacacgactgcaacctaactctatgtgctggggagttaagagttcctgcgccaaacatacataacctctgtagaactcccaagaagatcagtctattgtgttacaatataccgagagcccacctaaagaagatagtatcgctgtgtaagggcaattcgcatactttttcaaatttaggataacagttgcattaggttgtttatttctttctatttatttcctgacacttcttgtgttgaaatttgctgcagaattagtgttgagggaagggctaagctacaacacagattgtggaatgttgcaatgtaaaaatattagtttttaaaaaatatttctttcatttgtatatcacatacttatttttatgttttattttttctttatctttattgtatttatattttctttgtcaatatcgattcacctaaatggatttaagacactcttttgcttatttctctaggtaaaataggctacccattaatacatggtggtaatacatcccaagattattcgaactctaccaatttctatccttctctgcctaacccaagtcatgcaaagggctgcaagtgagacagggcaggacactttaagaaaaaaaaagagctagtgtggttatgtatagtgcaaagttacgtaagattaaaaatttggcataaccatttcactatgtgccttaaaacctacagggaagagttgagactttagggaactgggaagtaatgaagcctttaagcacaggcagtgaaattcatattttagaaggatagctggtgttgtgacgtgaaaaaaatgcatcagaggcaagaccagaaatgagtaggctggctagaaattgtttctagtaatgtaggtgggaaatattttctgaattatagtggcggtagagatagatggggatatatctgatggtttcaaagaaatgggttggctccatgggtctttgaatcaatcaattacgtctgtagggcaacaaaaaaggcagaaagtggacccctgattttatgccttaggcaaaaaatactatgagaaatagggtattaaatagaaaacaagttttggaatgattaatgattcacatttgtaagtgaccgaaaggagactcttcaagtcactctccaagggtagagttggacacttaacctcagttcagaaaaaaagtatttagaaaaagatatagatttggagataattcatgaaagattttatgaacatgcacaaattttgcattagatactgctgagaattggagaaagtgacacctatagaaacccagaggcattgctaagctacatggggacgaaagtgtggaccatcaatctatagtgccagcagtcagtgccattgcatatggctttttgtctcaaatgaaatttgcaaagaagggaatgtggactgttacatttatcccaatgtggggcttagccaggcaggtgtgacaaaaggcaaaggggcatgggagttgaaattacgacacgagaatattgaaagtgatgtttcatggaatgtagaatagagaggatagcaagtaaagataggggaggatggattattagagatactagaaaggtcaagaaaatggaaatctcaatgagcatgtagaatgaactaagagtcagaggttgtgtaaaaggataaactggagcttcaaatgtggagagtgcagctgttcttggtgaacacacggtttagaacattgccataggaagggttgctgacaggcagctgatatgaaaacaactggaatccagataaaggcattgaaaggctatggctattattcagggccctaagtttttgcaactgagcataattactggaaaggcaatggatgaaaattataagatgaggaagaagtgatgattgacaaatagggggattacaaaagagcagattttggagactggagggggaaagctgttaatatatttgctcttaatctgaaaaaaaaatcaatatttgtccaaaagctgcactgggaagagagaagaatgctgagcacccttggttttcagctcacctcttggtcctgagattcatagcataggggggaacaagcagctaacacttgtagggactacaggggacaatatttctttagagtcagctaggtttcacttactgccaagaagcaaatgatgtgttcagttctgagagtaaggaggttgggaagttatgtgacattggatgatcttggggttctagtgggcaaagggtgcaagcccgggagagaaggatgtggagggggcttgtgtcaagggaaagcacattgcagtacagagatgaaagtagaggtagtcacaagggcttatgttttttgttttgaaaaaaagacacttaaatatgttgatatctttaacgtcatggtgtaattagctatcttcagggtttcttttactcaaaatgcatagtctgaatggtttgtgtttccgagtagtcttgggttggataaaacagcagccactagtggagaggggtggtggtgagacaagaaggcacagagctctccggaggaagacaatcagaattggaataaattaggcttctaagacagctgctaagtagtagagaagggatttgaatccatctcaattaaaagccatgttattccctttatgtttcactgcactgtccttctcaaattttatagacaagaaatgtatatcccaccagccctaccttagaatagggggaaaaataataaacttggatacaaacaacaagagaccagagacatcaagatagcaatcatggatagatctgacagtaggagtcggcaatctaattatggaaaactgaggtacagaaggaggaaatccaaactcacagggatagcctttggcggaaatattgggtttcaaaaatcagaaaataaacagcactaatttgattcaaactgtgaccttgaggttagggaaacattggaacagtgagccagatatgcctttggttatggtggggtggaaagcatattttacttggtatctaaaattagcagttcaacttccaggcccttcttgctgccatatgtgtgattctgagtgaatgactttatctctttcaagtttctctgaactgcagcttgcttaactatagaacaaggatcatgtttgttgcaaaacatgtcatgaaaaataaatgagaagctcctttttctcattgtaaaagtcaaatctgtaaaatttgacaaattagaggttctacccaacaatgatattttcatcttctggttctcatttattcctcatgtacacagttgctaggttaatctcttagttgaatatacacctaccctgattctttccatccagattaaagtctttctttggtttgattctccaggagtctctagcctagtgagaccctatctttctagtatccttttctatttgtaaacataagtactttgtgccagctgtcttggtttatttgctatctgttaagcacacctgaactttcatctccagttctttttatcacagaaattttctagcaggtaaagatctcagacgacaaactcagctttcagaaagtttagcttgattatacccgtatataattttcttgagatttttatccaggcagagttagaaacttgatctcagtcaaaatgtctctcccaaagcacacacattttctctagtccttctttccaaagtttggatgtgtgtgtgtgtgtgtgtgtgtgtgtgtgtgtgtgtgtgtgtgtgttttctattcagggtttcatctactttccaaggaaattcatctggtttgggtaatcacctatgcaaaccagaactctctgatctctcgtctgtctatctggaactggtcctacatgattcttcactatttcatgccactgggggaacgttagaagttcagttctaccagggccctgggaactctatgcagccttctcaggccatcagcctcaacattccaaaccctttttgctctgggattgtgttatgttcccaggaaatttttacaaatataagcacggggttgtgctctttttaaatactctaaacacaggatcatttgtgaaagggacactcctttccccaagtgtctactcaagttttgattccgacctatatctttcacattccccaatttagcataattttatcagagctggtggttgacaacaggaatgttttaaattactcctctctttcttctcacaaatgtattcacttggatgtaagtgctagatgttcctctcagggctagaattttgaagcaccctctctttttgatgttaagttatattatgttgtttatgatgttatgttatgttatcaaatctccatgagatggctaagcatgaagttagaaatacagcattcatactgaaatgggccattccatgtagcaaaccctaatgtgaggatttgctttgctttacgagggaagtgggagggagttgttctcagtccttgtcgtgtggtagagaagtaaacatgggtgaagtgtggttcaacaagacatcaggactaggatcatgcactcatcagaagcattaagagaactgacaaaaaaaaaaaagaaaaaaacctctgacttttggagtgttggttccttcttttgactctcagtagaaacactgaagaaagaaataggattaatttaaaacaagtcaatctgaaaacataaaggagaaaaaagtacatggccctcctaatccaagtaatttctgtttgtaaacaacaatctgtagtgtctataatatttgtaatttgaaatctggcagggtcgccaaagccaagtgctcatcccaagctgaagttcatgtgaacaggagcagaaagatgagatgcttacttaaaaaaaaaaaaaaaaagataatcccgatgtcccaggtgtctctgaggtactttcattaaacatcctttgacagatgatgatggaaatcaatctcacccagaagatgtgcctaggacatagaatgggacaagtggcaggttaccagcacctccccccatttgttctgagctagatgctgggattaagttaaagtctattgaatgggtagccaggagatgtggcttatgcacagattctcatcgctacaagaggagagaaatttaagcctttggaacctggggctaaactcaatttctggctccatacaccagtccgtggaatttcctagaagcaaacagaccaaagctgactacatttttaagtgagctggattatcaaagaaattccaaacttgactgaaaccagcgagtggcttcttcatccctctgacaaatcttcagatcccagaaccattccactgagactgtaaggtggcacgctacctagaaaggaaattgtcccctgaggtggccatacaagacaatagacaagggagatatttctagaaagtaacttcctgagcagttgttaaatctcatcaaaggatggattccatttcaaggacaggctactgctaggttttacttaacagcagaatatgttttatgctgtggaactatatgttgtttccctttcctttttaaaatgaggattttcatttatattactgtattatttctctatgataatgtatttggaaaactggagatggaaaaatatatctttcagccacacatcactggactgtatgtagttacagccaactcagtgaacaggatggcatgtcaccaagagatcatatatatggaccagaatgtggcacatgacaccttctgatatcatctttgggaaaggctgatgtttttcaacagttatagggggtttgaaatatatatatatatgtatatatatatatatgtatatatatatgtgtatatatatgtatatatatatataaaagaaagtgtgtgtgtatgcatgtgtgtgtgtgtgtgagagagagacagagagagagaagtttgggaaaaccaaaagagtggatacttttggttatatacattccttccattgtatatacccaagtggtttaggatgaggtagagcccacaattcagcctcctcctagctctaggttgatttcaaccctcttgccagagaaatgaattgaggaaattcacaactaagtcaacagtgcatagtatcaccctgggtaaagtgattggttcagagacatgcttgacttagtttaggccaaagtcttctggaccagaaggctccctattcttctgggagagccaggagaggccattgcactttctccttttgaatgtgtacatgagacacttggccctgcgtcagcgcgcatgaaactgacactggggaaggaggagcacagagaaggggtgccttttattctatcagtaagccattgcagctctgaagatcggcaaccttctatttacgtgaccccaatcaattatctttatcatttaaactaaagagttggttttgtgttaattgtgacaggaaaagtcgctgttgttataattacttatattattatgatacatatatttctatttagcctctcatgtgtttcttctttttcacccaatgaaagtgcactttccttgagatctgaagttatgtcttatatttctggttctagcattgttcctaacacataataatggcttatgaatattggttaactgcatcatcaaagtgtttgacatgactagttaagttttgacttctgatatagcctgtttttacatggtctgaattcttctaaaggcaatgcgtttgaaaacaatcctttatttcagtcaaagagtgctttatatctgactctaagactggtgaatttcaaaatacttggttttctggcccatttttttaaggtagtctagtactctgtaggcactgtttccaagcagcttcctcaaaaccttgactcactaccttgctgaatctccatgatgaatagaactcaatgtattcctttactgacaatggatacactatgacatctgtacaataaaagtcagtcatttattatggtatatacacaccacagaatactacacagctatgaaaaaagaatgaaatcatgtcttttgcagcaacatgcatgcatctggcggacattatccaaagcaaataaacacagaaacagaaaaccaaacaccacatgttctcacttataagtaagagctaaaccttgggtacacaaggacacaaagatgggaacgatacaaactcgggacttcaaaagcagggaaggcgggtagaggcaagggttgaaaaactacctatcaatcaggtaggttcaccacttggacaacagaatcattaggagcccaaacccaagcatcacagaatatactcatacaataaacctacacgtgtgctcctggaatctaaaataaaataaacatttaaaatataaaaataaatcacagaaaaaatcaatcctttaagataaaattgtttttaattttatatggtttttaaaaattatgtagggattcatactttttttttaggattgcagaacctgaaaaaatatattatgtggctaaattaaccattgcaaaaaaaacccccaaatatttagaaaattttctctatgtgtaaatatttatttcaaacttgttttgcttcctcctgtgaagcaagagcatatagggtcatgacccaattacagaacatttgattgtctcagctcaatttcataactgctcaagagaaatccctgaagtaaaatttatcattattttctgaaagttgtttgaaaaagaaatgttaaataaaatagtttcatcatatcttttggttgtgcgttttttgtgccccaaaacacaaatactttaccctcagaccagccaaaatatctcatagaaagttttaaaataatgaatgcaatgaggtaattgaataccatctaaataaatgctcattggattgaagtgtaattttcttaaaattacagagtctgaagtttggcagttttccttaaactctttcaaggttattttgtctttcctatttttagtctacaatttcacggggagttagcatctgttataatacaatgctagatcattacaggtttttaatatcacctgttttctacagtttttcatgactcccttgttaattttcaagacagttgactcatcagcctagaagctcctgtcatcctggtatctgaagggcaccaaatggatgagcatgaatgagcttccatttttagattttgttattcttttgcatttgttgatttttggtttctatattatgaagttttctactggtattatttactagtgtacacaaatggccacaatttactgacatcataacaaaatggttttgaaacaaaatatttttgtaaattcctctctgggacttctgatccagggatgttaagccattaataaatgtttgtttattatagctttttttaatttaagggatgtttttccatagacttctgctaccatagaggcatgatcaacaaataaacactgattttctgaaaacatgatctctctgagcacactgctttattgcattcttccctgttaccctcattccttttcttcccaagtccctcttgttttccatttacagaaacaaatgaaaacctattccagaagtttttgcaaaaaataaaatggcataatgctatatcatttcctttgaagagttgaaaatagaaagtccacttaagtcaggaatcaaggaagtcagagtgattagtgaatgaaactcacctgggagtccaaaagactagatgatcatttgccaatcaatgcagtggtattaaatatgtgtgtgatatccatctattctttcaagttttactaatgcgagccaagcacagctgtgactacatgcctgatagaccaatagacatactgcccgtggtcacgtggcttacgttatgatgtggagaatgcatgaaaagtgcacagacagttacagcaggatcagggaaatcaaggacctgggagaaactatgtcaagtgcaagtgacctcattttaggggtcaagaaaggctttttataaggaagagacatcctccttgagaatcaaataatgaggaggaagttggccatctggacatgggtagagaaagagcactctaaaagcaagagggcaggagcctgggggaactggaagaagtccaataggggagtatcacagagcaagtgttcggtgtgaggtcatgggagcaagagagtactatggtagggtattctgaataagcacaataaggcaggatgggtaagcataggcaagaagtggatgttacaaagaatgggagaggaaactgacgagggaaacagaatccctggtcagtgctgcagggaacatgaagatgacaggaaccattcgtgacaatttggatcaaataaaaggatcaggatcacatccaagaaaacacatgacactcttcctggtctctgtggcaatttctgtttttgttcgatttcatgagtataggacaaagccagaaacaaccattaaaaacaacaacaacgaagtgtgagtactttgcaactataactcaacttggtcagttctgtccatgaattttgttactaaattttcactacttccaaaaccaatgaaacttatgaaaaccttaataacttagtggttctcagaatcttagaatgatggagttaaaacaaaaaatcagcaaagggttgaaagggtgcctattctttcacaataccaaaacactcacatattcatatgttaatatattttggtaaccatagaaaagtgggagaaagaaaaaaaatttgaccctcttttcactgccattttggagtattcctctggactatgtccttaataacataagtatgctcatgctttacatatacggttctcaacttatttctctgaagggtatatcatacttagttttccatggtattacaaatcttttatgtcttaatgaccattgaaaatatcactttctaataccaatgtacatatgtgaaaacctacttaaccatttccataatgatgtgaatatttttaaaattttaagttacaataaaaattttggttacattacttaactggtgggttggtttaataagtaagatatgctgatcattgtgctcagtgttgcatatacaatgataggtgagaaacgatgattgcttacagagagtctgctgtcttctccatcataaagtgttttctacattcagaatgtttaccctactagggatttctgaatgtgaaaaaaaataagcataaatatagtaaaggcttctggtagttattaccaaattaacttcttaaagagtataccaattcataattccccccttaaaaatatataaaacaaacatattttgtattatttgatccagacttttaaattacgactaacataaaactaactcaaactatgattaagttagaaaagcaaagtgggagcaggaggttcaggacattgatttaagctccagtaactaaataataaagggctattgttggcttcaggtgttgagagatccaggggctcagacaagagcatctgggctcaggttttttccatctcacagctctgatttttttccgatggcttcactcaggcaggctctgtctacttgggcatatagatattccaagttccatcctcccagatttttagtctagcaaaaagtgagcacatttctcatttcaataactttaacaaatgtcctagaattgactttcattggcatggctcggtccttgttaatcttggaacaaatcactgcgccatgagacgaaatgatgaaccaactgtgaactgatgactgatgaatcagctatgaaatacactaattggcaaagcctggataccatgcctcactcaaaaaacaagactgagtgcctagcaggggcagtttcccaaaggaaataagaccgttcacataaggagaaagagcaatggatactggaagggcaaagacaattgatattcccttaaattggcagtatcatgctttaagcagatgagaaaactaaactcaagaaggtgaaataactcagtgtcatcctgctaattaggcactaaactgagagtaagacccaaatccatgtgctcatacttcagtgctatttggataattctatatttcttcttttcattatcaacaaataattggctacctattgtatatagaggtttgctctttatagtagctgaagatttagttgaatgagacaaaaacaatatgctaagtgacacaaatcaataaatagctagaagaaaaatatgaattcggttgagagaagtgtaggaaagcctcgcaaatgaggtgaccaacctgggtgaatcaaaaattatatcatctctactgcaacgagcacattttgggggacgcattccatcacactccaaaaaacattttttccaataaggttcacgtaccctttcctccaccacgaggggcatgtagctctggaaaccacgtgtggcctgtgtctctctgaatgcggaacccaggctgagttggtcagaggtgcacagtcaagttctgggccagtcaagttctcttccacaggaactcagggtttctgcaatctcagcgagaaaccagaactcagctgaggtctggctatgagcacaaggtttggtgttcagaaaacaagcagggtcaagagactacctggtccttaatgaattcttagattcctgctgtcatctcggtttgaggttcttgtgaggcacagtcattgttctgtgagttcagcaaaatatctcaataccccctatattttactgaacttgtttaactcagcttctagtatttgctgcccaaagcaaatattgaatgtgacattagttctgatattcatctttctttcaatttctctaagaattgaatcctaatatttcctattttccttcacacattttaaaaccctaggttctgtcaactcagctcagatctatttgatttccttcttccataagctcaagaaaatttacagtataataattttatgtatagttttttaaaaaatagttaagtttcagctagactgtaaatgtcctaagagaaggagtcactgtttcatgtttcatgagatttcacctgtgtacctagaaaaagatgcagtttattgctcataaataataatgggtcattttatttcaaagaaatttttcataagtgttttacataaacgagtcttccaataacataaatattcataattagctaagtcctcatcttcttatgtatgaaactaccacatacaatgacaaaagcaatcatggtttcccagggaacagccctgagcagggattgtacagctgggagtaaatcattggttggaggtgctctatctgtaggagagccaagtgcagccaggaggggagtaaatcattggttggaggtgctctatctgtaggagagttaagcgcagccaggaggaatcgcattctgcatttccaccattttcccaccaagcttgttttatgggtcaaattgatttaaataaattccaaaggcagccttaatgagcaaaaactatcaccaaaaggaagccactaggatgtaagtggtgtgagaagagcatcagtaagtctttgcctcagccactaatatagaaattgtgtggatattgcacagatggggaaatggagtcaactcttttctcagtgcccatctactacggcttccccaaacttattcccaataaggaataaagagaatgaaaaactaggatgtgtttacctttttatttaaatacttactgagtaataattatgtgccagacatagtactaggaaaatgagattgcagttgtgaaaaagaagtgccgattgtttgatttcacaaaacatatcctctattctagagggagatgcgaacgcatgaaaggggaaccctgatatggtggagtaagtgcagtgaaaggagaagtgttctggagacatgaggaaaaccatacaacccaggaagcagaggaattttcctgtagaaagtaacatctctgctgggaatattcaggtgaggaagacgaagtgagatgaagaatgggtcaaaaatggaaccacattcccaaaggcccagagaccagagcgaggtgcaggaagctcagtgcatctgaaagttatccaggatggccggagctcaagtgtgaggtgagcgatcaaaagaaattaggctgtcaagaaaagctgggacgaaatattaaagggtagtgaagtgtgttgtcagacacactctacttcacagtatactttataggagaaatctaaggcaggcagggacataatcagcaggcatttcagaaagctgactgtcatagtaaactagagaagatatcagaatgggaaaaaactcaaggtggagacgttagaaactagttaagagacagtattacagacattaatccagggtaacatctgtagaggcctgcacaagactccctgggagatgaagcccagcggatgttgcatgtcagggtctacggaagaaccttatgcaccttgtgagccccctgagcagtcagcatacgggtcgttatacgtttttttcagcatccctaccttggatcaactcacacaggaaaagatgtcactagattacagcagagtcatgctttcctctttcttatgaggtgctcagctgaaacacggacttggggcagtcaatttcccctgtcctttctttctcactaaaagaaccacgatttgctcagggagtctaatatgttcaaaaagctgcttcctgcccatttccctgcaatctctgtggcctgtgagaggtgaagtctacagagtgaaactgcaaagagtaagaagaggcagattccactccacatgcttgtttcctttgctctcagctcttcttcctgtctggaatgcagacgtgttgcctggagacacagcagccaccttaaggaccatagaaacaaaaagccaaatgccaaggatggtgcaaaaagaagaaaagggaaactgagtccctgagaccttaatgcaactactgatttgtgtcagtaaaataaacctttgtttacatcctggcaattggctcctttaacattcagctgaaagcagtcataagtaaaccagcagttttccttgtcacttgacagagccctctggtattcttttttattttccttttttgttgaaatagtaaaatgagtattctttataggaacaaataaatatccatcttgatcttccaagctggctttcctaggcagagctttgtgagggaaattttcacggtgatatcctcagtcttctgtgaaggtgggataatatatctccaaaagaatttgtagtaatgtttggctctctctctctgtccacttacagttttccagccatgaagacagaatcaaagtaatttgatttattcagggaaatagactctctcatttccatagaataatagtgaagaaaataaaagaagataagacttaactcatcaattaactttgacattgttcacttgcctgaacacgccgtctgtgtcagggaacttatcttatccttgttgtgttataaacctttcgtgaagcctttggctcctcacctacctcatcccagcacaaaacagtatgttcttcgctcactcatttatttactctttcaataaacactaagtgcctatactaattgctagcattgtactgctcgttagatattaaagacaaacaaaattccatccttgacttcaaagaaggtgcagcatgccaggacgggggacatttaacgaccaacagcaaatgtcttggtgctgtgagtcgggcctccacagtgcagtggggcagcgtggagaagtgggtagttctactctgagattaacaaagtgtccataaaagatggagtgcttgagcaaatattgagtagatgctgatactcaacaagggaacaagggaagtatccatgccaggcacagaaagcagtatcatcaaaggcacatggtagaaaatggaatatggtacatgagcttgcaaaaaattatgcaaagagaaggtcagaagctgaggcatagatagacatgaggaactatggccatatagaaaagggtgatataggccaggcacggtggctcaggcctgtaatcccagcactttaagaggccaagacaggcggatcatccgaggtcaggagttcaagatcagcctgaccaacatggagaaaccctgtctctactaaaaatacaaaaaattaggcaggcatggtggtgcacgcctgtaattccagctactcgggaggctgaggcaggagaatcgcttgaactcgggaggcggaggttgcggtgaaccgagatcgtgccactgcgctccagcctgggcaacaagagtgaaactctgcctaaaaaaaagaaaagaaaagaaaagggcgatataatcaaatatgaatctgggttttagaaagatcattctagaggcattaagatatctcaccagactcagagaaatgattgatttttgccctccacatttaagatgagattcttaatgtcctagggtagtagttatgcctctgagatgacaatgaagaacaaatgtttaaaatacaaagaacacaaataaggaagccttggtgattggagatgggaaataagaaaaaggccattccaaagattatctaaatttcctttttgggtgactaggcaaatcaggattccattttctgacacaggaaatagattaaaaagaagaaggtttgaggaagaaagattttcaatctggctttagactgagcatcagtgtggtctagcagaaatgtacattttggaagaagacagagttgagttcaaaccccaggtgtgctgtgtattagatctgtggccttggttctctcctttatgtccctgagccatgattccatctgtaaaatatggatcacaatttcttccttgcagaattgttctgtcttacaatatgtacaagatgcttattggtgtctcgtgaaatggtgactgctaccattccaaacctggcaggggtacctgtgtgaaatccaggtgagattctccactggctgctgcagagctgagattcattggacctcgatgcatacatgctcctttattgaagatgtccaaaaatgttggtcacatttcagttaatctgatgatgagagggatgcagtgaaccacagaaaaggatgaatatcttcaataaggatgagaagaaaggaaatatctttctatcaattgctttttgccaggaaaatttacacaaatatgtcatttcaatcctttcaaacccagggaagtatatgattttatctcaaatttaactaataaggaaactgaaattcaggaatattaagtggctttcccaaggccacacagccagtaagtccctattaggaattgggccttgataggcagcaaagccaaggtgatgtcactacacgagagtttgtgtgtttcttccatgctgtagtcttcctttccccaggtagatagagaaagggtcaaatcgcacaatgctttggttgtgcgcaggaccataatggccccgggtgtacaggctggcgacttactgatacaagcctggggacggagctcacggaaagctcagcactgagtcacagacatgacttagaagtgccaaacttcattttagaagacctgggagggtcatatttttttcttggaaaataaataaagtaagatttaacaacacactgtgtttcctttataaaataacaaatgccctgcaagaaatatgtattatctctatcactcgggggaattcaacgtagaatttgtccctgagctttagcaagggctgtgagagggatgcacactgccctctgctggggggtgtgtataagcacacggtgtacagtgcagtcttcatcaaaggagctgtattttgtatgttacttagaaaagtaacaaagggtgacaatgtgtatgagcgacacagtgtttacagatgcatccctgatgcatagtgcatccccctcacagctcatcttaaagctccaggacaaatatatatactgtgtgtgtgtgtgtgtatatatatatatatatatttccatattttctccttataatatcacagattggcaaatgacagcaatctttagcttttgtttaaagatacagaaaatcaagatggtcaatgagacctccaaggacatacaaatattcactcatcagagcaagatgtaactcactttagcattctctataaaagagcaattcatgattattagaatgcacatgaatcacttgggaatttgtttaaaaaaaaaatgggcctcattcccaatgactctgacctagttacttgagtgaagcccacgaatttgcatttttaacaaatggccacatattctgaggcaggtcattcacagaccttgttctgaataaacactgatctacaatcctctttatctcccaaagttttttattaaaagttgacttgcagaaaacttcagattttaatttttctttccatctgtgtaaccctaaacaatattatttaccctcttgtgtccatctcttcatctgtaaacactatgtgttgctcatacaaattcttaccctttgttacttctctaagtttgtgaacagaaatatgtagcacttatatatgggtgctcagttgataattcatttctcaaaggcattactattttaaattataataaaaaataggcaaactgccggtcaggtcctattttccacaggacacatacaggaaaataagtcttagagacttagtaacagctggtaagggcaaaaccttgcttaaacttggactttctaactcaaatccaattctcactttgctgcagactctgtcatcggaagcttttctcaaaattcttacccatatgtttttaactaagaaataaaggcatactgagttctcttagtgccctaggaaatgttggtcaaactcaagggaaaactctggaatattttctctgttcttcctagtaaactacctgacgtctactgggtgccctatagacattgtcagatttattgtgaggccatcttgggactcacactttgaccaaagtaaaactgttgctctaattctaatcaatctctccccaatatataacttgagtggggattctcatgagaggatacatgtaagagttttcctggctagaaacatatttgtttttagtttgatatagaatcccagagattacatttgaccaaaacatttccatgaccttttccctgcatcataaatcacaaaaatgtaaagattatccctatatgatttaatgctatgataaattaagttttaaagtatttttatggatagagaagtatttgctaacaattctgttctatactttttctgttgagaaaacacacttcctagcccttttaacttctacatctctgaaaacctcaggaagaaagtgtgttaggggatatgaatataagagaactgtggctgaattttaagaatttcatgatctcaagctccttcttgcacaattgaaatagaaaataaaggatggctttaacagggaaggtatatttagctgtgatttaaaaaacaaacgaattagataaattagcagtagtttgcctgtttgaaaaagcaagaatctttcccaggttattactttggttgttactttttctcttcaataagagagtagaccaaataaaagtttaatctaaaagttaccagttcagtctaaacaaggagagcaagaaactacattcaagcacaaacttaacattagataattacatttcttaaatcaaacttttggccaaaatggaactgtaggcaagcttctattccaaaaaccatccaaaacaattcaaaatgctctaagaatgtaacaagacacagcaacaagacaaatgatagaaagcatttaaaaaaaaaaaaaagtcctcaaattatagtgtaaaattcagaataaaagagttgcctcacttagaaagctttttttaaaaactcatataaacacacacacacacagatacacaatccatatcatctacaggactgatgaatggataaatctatttaaagataagctacacacatatctgacataaattgtaccatacttttcatttcactcaataaatttctaatgaaagaagaaacagtctgtgctaaaatacaatctatattttaataataactgatccaggagcacctttatatactctaatctcaagtgaaataatctctaacataatagaaacttgatttctacttaagtaatgttgagtttcttttaaaaaatatttttttctctcttaggagattcttttgtcaacattacacatatttagagagtgttctgttcaccaattaaaaaaaaaaaacttccaaaataaatcccttcttagcctttttcttcaatggcagggatccaatatctgcggtaattttgctccttattattattttttgcccaaacccatccatttccatccttccttaatctcttctgtgcccaaggtgacacatggcaccctgtagaccctgtgacctctctaaaccccatgaaatccggcctcattcctgctggttccagctggtacacacaattggaggcatcagtacaggactctggagctccggaatggagaaatgtcagcatattttccctgctcccttccttctttgttccattccctccctgtctctggccccattacttgcttccagttttcattaggccctgagaaaattaattcctccatttctcccttttgccttggagtcatagaggcttccactgtttcttgcttctaagatagacctttctctgcaagataaggaagcaagcaatttgggaagtccatctggtgccaagtacatctattccaactctgcatttagaaactgggaaaatattcacatggtgtttccagggactcacaatgcctcagtgagatggctctgggtgccaaccgcacttccccccagacctccacagtcacctgtccctttatcccctcaccaccaatgggccatggtgatatgttgagccagcagaaattaatgtaaacgcaaagccagcattgagaaacttttggaggatctgggtatttgccattccccaattcaaagttatcctggtaaatacctattgtacctctagtgaagacatagaaaaaaatttagagcatatacttgaggtgcgttatgggaccctgcctcagaggaagtgtctcttcctcaatcaatgaactccagatccatgaacagcctgcattctaggaactgggtgaaaggctgtgtattactactattgtgatcttggtatatttctgtccaccatactgggattttcccccaactatttagatcaagcaatatcttctaggctgtcaactgagtattatcagattcaccaaatcataaggctgaacacaagtgtaatattccgttactaagtggggctgatgtgtctgagacaggtcccaagcaagttcagaatatgcatgtaaactgcatgtgtctagacccacccttgctgttttgtggtctttcttcaactcaaatctgtggcttagtaggaaattctttataaccagtatgactagatatctgaagagaaaaaaaatgaagatatagtgggttttttcaagatttttatgctaaaatttggatagaatatagtatagtttcatttcaaagtgaccttgatagatggctgtaaaataaaatgttcctgatagcaacaattgtgagcatatagctggttgtccacattggtttgtagaaaaacataatttgaggtatagattttcactgcaaaatgaatacagggtaataatttgaccagttgaaaagaataagattggtaaggttgagaagaataaagtggtctttggaaggagtattgggctgcatctcttgggatgagcacagtgtatagatagttgtgtgttcaagaaatgcccagtagggggcatccactgccgagcatgctctcaataagcaggtgaacaagagactttgtgccaacagcagaaagtggctcagagcctcgagcgtggcacaattccttcaggtgttcaggagcaattggttgctatccagccatctggtggaagttgatgactttggcttccttagattagggaggaccaatagtttgcccttctgggaataaaaacatggcaccgaaacagatttgctttcgttgtctgcatagcttctgctagcatcatgatccgtttaagagaatgccttattctccatttactattcctcataagattattctgattcagaatttcacaaaaatatttgcttcccatacccacaaccttgcacttgaaagacttaggggcgctagtcctaagagagaaaactttcaaaaaagggaatgaagccttagtcccattaatgtagaagctgagacttcttcctggtcattttcaactcttcttgctactgcacaaacaggcggagatcgattcctattaataacaggaggttggttgctgctatacaatgtggacagagagttctatatctggaatccagggtactcttcagtatacctcttaatagtcccatgatcatttaaaaagtcaatgaaagctgtgacaaaacagaacagtcttctgagagaaagactagtggggttggaagaaaaactacttcaagcaacaaaagctgattaaaacttagccttgaggcaaggatcaaatcaaggctaaagctgtttattcccattattaaaaccctttgaatggattaaagtagcacacagtaaatcctttgaattggataaaatagctcagggaaaagagattaaaggtgtggatctcccacctcagcccgattggcctagggcctgtaattaagttgagggagagcaagcatggggcaagaagcaaacaaatactgtaaatctgagaaatatgtccaaaaggaattctggatgtggttaccggaacatgtaacggactaagtcaaacattttaaaagctgctaaggttttaagagagattactattgaaggagtcatgagcatgagccaaaaaataaaaataaaaaccttattcaagaaccaaaataaccctcagtccttaagtttctggcaggccaggaacaggctgagaaagccgctgaacctccaatgacaacatagcatcacagtctcatgtccaattcatatatggccaagaagaataataaaaaagagggaggaataaacaactggaaagagtagccaagggccatgggaaaaagttaggaggggggccttctaggaacatgaattactgtctaaacaatcaacattctccactttcccagaataagggcccctcatgacatttgtctagcaggattttagaatatctacagaccagcgacttctcagtgtttcccattcttctgatagtgatagttgtctgtccctgttctgccattgcacgctggggttgaaggtggacgataacttgtctgtacacagatctgcagaccaagagggagcgtgtctggatgaatagtatttggcatcacttggatatcatgggcatcaaagctagtatatgttttgttgttggagggagagggagtgaccgaaagtgcagagtagtatagtcattagtgccgttaatcaaatattccttttttctccatttggggcacgtgggtcagattatacttcctggctaatttgaagttgctttgaccagtgaaatataagcagaattccatcttttctggattgaagtcgttacacgatttgccacaccctctttttttctctgccatgattaacaagcaatattccatagaatagaagttctattgtcctgagtgaggacagtgctgaggggagcctcagccagattgcacacgtggtatgagagagaaataaatcgttgttttaagccactacgacttaaagttattcattatcgtcacataacctagcccattctttgacttatttactcaaattcaatcattatcagacttgggagaatctgtgacttccattcgccacattatttctcaccctttttaacctctcaatttttcctcccctccattgacaatgctggaaaatgcaaccttttcttatctaaaatagcatgttctcctttaattattttgttatttattactcttaatctataatttctactcagccattttaccctggccacattgatgttagtcctttagaatgtttctaaataagccattttttactaatgtaataaaactcaaacctttgaaagaaggtatgaataaaatctagtttgaacaattctgtggatgaatacacatagtttaatgatacatgcgtgtttttaaaatcagattggctatttaagagtcatcagcctcaggaaaactcgcagggtgggtgtcttacatgtaagtttcttcagtcacacataaaatgcatggaaaagaaaggccatcacgaacgtatcacatcgtattataaagaacagagagttctaagctcttcttttattcgtaattatcattctactctaactcaaccctggagcacctttgaaaataaatctcttcctttccattttttttctttctttttacaggcaattcatattatgcaactataaaaatgagcagagagccttcaaacatgtgagcaaactacaaaaagcaagcaaccttggaattgaatttcctatttcttcaggtaccaggaggtagaagacactgtatcagggagatgttctctgctgtttctacaggatgagccacaggcccagattttgggcagtctttgaactgatgcttctggagtcacttctacgttccaatacacggttttattttatttatttatttatttttgagacggagtcttgctctgtcaccaggccggagtgcagtgacgcgatctcggctcactgcaacctctgcctcctgtgttcaagcaattcccctgcctcagcctccaaggtggcttggattgcaggcacaggccaccacgcccagctaaatttttgtattttagcagaggtagggtttcaccatgttggctgggatggtctcgatctcctgacctcgtgattcacgtgcctcggtctcccaaagtgttgggattacaggcgtgagccaccgcgcccggccccagtacatagttttaaaggataacaggggccacctgtcataagtccaccaaaccaaccagagaactgtgaagactcaactgccactaaagctgccagctgtcccatcatttccaaaaagaccagttttgtagttccaatttctgagtgtattagaatatcctgaaaactttttaaagaaataaattaccgggtttctcatttaacctgataaataagaatttttttatggacaagttttttacaagattcttagcaggtaactgggcttgtcttactatttggaaaccagtgttttatttagtagacactaaagtttagtagttcctaattgggcggtgggtttgtccagagagccttacactaactcagcttcctcctttccctgcacatctcagagacatcattaagggaaattttcaaggtttcccttatgtatatgaatattccaaaatgcctgtaaatttagttaataatttagaagttctattatgaccatgatgctaactgaagacccagattctattttataaagtgttgctaaactggtttatagcaatagtaattctctcctcatttcagggaaacatgctgcatatgaaaacctcttcagtttcaccccataacctcagacaacttccccaggcataactccttccttctgcggtaagtagcagccctctgtcatcatcgtcactatattctgtcccttaaactggcatttgttttatgtttcaataatattaatagtcacatatttatactctgatgttaacttttaattttaacttgccattatctgatggaggtgaactccattatttttagtttaaaatgtttctcagttttctagagacacaccataagaggtatgttgtgatcatcaaatggtgaagatttatcccaagtactttagcaggatagaattcaaatcaagctttggataatatactaatgtgttagtgactgtaattaattttccaatgacgcaagatatatttaaaatctaatcattgttctgataatagcataatgttggcattattttcaatcatcttaagtgtcctggggtgggggtcagggagggtgagggaggccatacagtcatcatttgtcaaccagaatctttccttttttattgttttataggggtagagttgggtcagaattgagctgagacaaacttgagaagtaaagtaggaacaattttgccctactcttccttttctgccaatgcacatttctgctcagcctgctgcttaaatgctgcctccatttgtggtctgataatggattaaagtgttagccctctcagggttatttgtattttaataatgcaaagtaccacatgattttaagaactgcaaggctaacattctaaaactgtctcacaggaatgtgattctgcttccttccaatgcctctgatgcacaacctcctctcctctctccttaagaaaagaccttgaagcaggttatggactccccagccttcctggagtctaaggaacatttccctttgtggatgcttacagtgcaagcccgattgggttcaagagtcaggtgactgtagttcatcagctgctgaatatagttacatgctgatgtctatcagaagaaaacatagtcaagagacatttatgccacccttaaatatatatattaagttattaaaggatataaaaataattattccactagcatcactttgcagtgtcaagatatatagagagacacaattcataattttacacttaattaatgcagagtaataagctagtttctccataattgaataacagcctgtgctgagtcttctgacaggctttgggcaataagcttgaatggccttgctctgattagtttaagacatgcttgtgagtgtcttttttttttttttttttggcacagatatgggtggtttaacagagtatataaatgtcagggaagtcctttggttatgaacagtgagtcacaaaatgattatggacatcataggttatttattgtagttctaggacattttggaactatgatcattaacataatatagttgtgaatctttttggttttctacatctgaggaattaaatggaaaaaggccatcgaagaacttttcactttcatgcttgactaccttaaagaatcctacataaaataaatccaaattttattgcttacattttagagacagtattttatgaagatgcttaaccaccaggattataaggacaggcagagatatacaatcaaacaccaagctttgctttatcttgaatggtctagattaaaaggtaataatgttcactactaattttcaagcatatttaatgccaagcactataagtacattatctcatttcatccatttaaaacaagccacaaaaaaggtacacatctccccattttacagttgaaaacattgaggctcataaaggcttatttgcatactttcaagcgcctacatttctaaattcaaagctcatgcatttccctcagtgtcatgctgctactctaattataaaagcagtgtggaagggacaacatgaataatttaatttgactcgtgtgttggctgttttccagctagttaccatctctttactatgaacttgattaaacaagccaagcttggcttaaaataatgctcctcaagcaatttgcatctatctttaaggttggcagggaaactgacctctgccaatctgtttttgcttataaccataaaacatacaagaccttggataaaacctaaagggaagaaaaatgtttttattataacaattaagacttacgcatgagctattcattaatgccctgaaagttgactttttggcataggaaatacaatcaaaattccagagacatcccaaaacttttctatcacacatttaaaacaaaggaacaaatgagttagtagctaagtgaagcaatctctacagtattaatacagattttgatatattttaaaactaacctttaacttattgagcttatgcataggttatgtatcttacttcctcatggagatattagcagattattttctgaatgattttttttttttgctttgagtttcttggaattagaggtgttaaacatccagtatcttaacaatctacttattttttaatagaaaattattttagcagtgtttagtagttctccttgtagatatttcacttttttggttagatgtattccaaagtttttttcttttttttggtatggctattgtaaaagattgcactcctgatttggctctcggctagaacattattggtatataaaatgctactgatttttgtacattgattttgaatcctgaaactttattgaaatcatttatcagctccagaagccctttggtggagtccatagggttttttagatatagaatcatatcaacagttttaagagaaataatttgacttcttcttttcctgtttggaagacttttattgctttttctttcctgattgctttggctaggacttccaataccatgttgaataggagcagtgattgtcagcatccttgtcttgttccaggtcttaaggggaatgctcccagcttttgctcgttcagtataatattgacggtgggtttgtcatagctgaaagaaacatagatgatacaaacaaatggaacaacattcgatgctcatggattggaagaattaatattgtttaaatggccacacttcccaaagcagtttacagattagtgttttcccatccaactactaatgctgattttcacagaattagaaaaaactattctaaaattcatatgaaaccaaaaaaagcccaaatagctaaaacaatcctaagcaaaaggaacaaagccaggggcatcacactacctgacttcaaactatactacaagcctacagtaaccagagcagcatggtactggtataaaaacagacacgtggccaggcgcagtggctcatcatgcctgtaatcccagcactttgggaggccaaggcaggtggatcacaaggtcaggagatcgagaccatcctggctaacacggtgaaacccatctctactaaaaacacaaaaaattagccgggcgtggtggcaggtacctgtagtcctagctaatcgggaggctgaacagaagaatggtgtgaacccgggaggcggagcttgcagtgagccaagattgcaccattgcactctagcctgggcgacagagcgagactctgtctcaaaaaaaaaaccaaaaatgacatgtacaccaatgacaggatagaggacccagaaataaagtcccacatctataagtatctgatatttgacaaagttgataataacaaataggacaaagactccctattcaacaaatgctgcaaggacaactggctagtcacatgcagaagaatgaaactgggcttatctcacaatatacaaaaattaattcaagatggattgaagacttaaatgtaatacctcaaactataagaatcctagaagaaaacctagaaaaccatgacagtccccagtgtgtgatgttccccaccctatgtccaagtgttcttattgaggttgaacatttttttaaacactttcataaatttgtgttttcagaagaaattcagaatgggagcaaaccttgcatccctaaattttgtaattaggctaaactaaatgaggtgaaatttaacagaaagttttactatccggaagaaccactggcatttcctctcataaatgtttcttgatctaacttttatattcacaggaagaaagttttcatgttgatttacctatcagtttggacagcttctaattttacatttcaaataaatgttacctcttgccttgatcttacttctcatattcacattgtcagtcttcacccttgtcacctatgtaacaacaatataatccatcattcacccttttcagatgggcgtttcaatgacatcacattctcaaagtgaccccttctctcaaacgaattttgtttcgtggtttgtttttttacaaactactgtcaaacattctcattgcttgaaaatatggagatagctatatgatgtttggagcatgtaaaagcacagcaactaacttcttcctctgattcaccaaatgtacagaaaacactatataaacattttaggtttaaagacgtggggatcataaagtgaaaagatattgttttgaaggttttactttatttgaagattaaagtggtacaatttaaaatattatgtctctgtgaagataataaatgatcatatattaaattttatattatacatataagtatcataaaaataacttttaaaactgtaatttttagaatctaccaagaaccaatgaattcacatcaacattaagacatctattataaaaaacataatttcagatttattgcacatatattatatatgcaaacatattataaatcgcacatatatattgctcgtaataaatatatgcatgtattaaaggagatttatatacttatattaaagaaaatttttatgtttccttcctgtaccaaaaatataattattatatgcaacaattcttttgagatcttcatagtagagagagaagaatgctgttttgtattaaattttggtgcaatttatgtaaagagagttgcaatgcacttttttttcaaataagatgttattgttctcagcaggtaaaattatttagtcccaggttgtctgtttgacactaacttcaaaaaatatgaaagtgtgagtttttatgtaaatttacacaactgaatgactatatatattttaccatactctacaaaatagttgatataaaaataatataacttatttatggacaaagaatcaatgaaatgttatatgcagattggaccctgtagatcaaagtgccccaacttataccctgcacaatagtcctctcatcatattcaatgattccaaacataaccaaccctcctcactatcattctcccttcacggtatttatttccatttgagtatatgtgatgataacaaaataagtagaatatatctctgagcattcaagacaccatgatttggtgaaaataaattaaaaatcactgtactaaattaaaataaatttcaagatgggctagatgatgtttgggaacagaacgaataccgcaaaattcactcctttaagtgttttcacaagtggaaaaatgtggaccaaaataatgatgctatctgaattctttatgttttgatctagttggtatgttcattgtcaataaaagaaacctaaaaccacaccaaatggcaaaatgttaatacataacttcaaatttgagtgtttaacatgtcttaaatgctgctgtaaagctgaaatcttgggaattttaaacagacttttctttcggtaacatatagctactggttgcttcgaagcaagacaaaatccatagttcattaggccagatatagggcactgtcaatgggaactgagaagaagacactgagacaagaagcatattctggaaaaaaagatagaatatcttagactatagcacttaatgcagttttacaagaattatcatagggttcagctttctgtcaaatagaaactgagctctcagttcaggtcttcttgaagaaattattctcactaaaatatatttaaaattcttctgactttgtcacaacacacagaatgctgatgagagagataacgtaccatgttttcttcacacagagcacttgcaatatgaatctctacagtgattcccaagttaaggattaaggcactcaacattttgcaaagtataatcaaggaatcattttacattaaaataacaatgatttaaattgaaccttaatattcacatttgcacaaactaagtgttttctgtatccagagtgaccacaactaggtaaacaatccccttacattaccaagtcaaaagtatagagttcatgtggctgcaatgtcaagactgatttctcaaacccagcactgtcacttcctagctgtgggtaagccacttcactttcctgagccccagtttctttcaaaatggcattttaaagagcaacctacctcattgtgtcattttgagtattaactgatattttgtaaatcatttaacacagagcctaggcaataggtagtcttcaaacatattaagtatttctattttttagtagggcttaattatttcagaatataacaacatttacaatactggggcattaatgaacttattaaacctaatatcgttgttaaacaaggttataactataatcacaccttctggcacatacactctaacattttgttcaccctttctcagttggtagaacactatttgtcccaagtacatccacttaattgatatttattaaaacaataaatataatatattcagtattttctacttatttttgactagaaaacaacacaaaaaaaacaaataaacaatcacacattctacgtaaacttccttggagccaatgctaggtagggaggtgatatactttgttccacattttcattcactgtccccagaactctcactctctcttgatcttgtcaccctggggctagaagaaaaagaagacttacatccagagagaagggaaggaagacagtaagagaggtcaccctatagtcacacccacagaaagtgaagatattcgcaaacaatgcatctgacaaaggacaaatatccaaaatctacaatggactcaaacaaatcagcaagaaaaaaatacaaataattccatcagaaagtgggcaaaggacatgaataaacaatttgcaaaagaagataaacaactggccaagaaacatatgaaaaatactcaacatcactaattatcagggaaataaaaattaaaaccaaaatgagataccacttcactcctgcaagaatggccataattaaaaagtcaaaaaataatagatgttggcatggatgtagtgcaaagggaatacttttacacggtgggtaggaatgtaaactagtacaaccagtatgaaaaacagtatgtagattccttaaagaactaaaagtagaactaccatttgatccagcaatcccaatactgggtatctacccaaaagaaaataagtcattatattaaaaagacataattcacaactgtaaaaaatacggcaccagcctaaatgtccatcaaccaatgaatggataaagaaaatgtgatacatacatatatatatatataaatcacagaatactactcagccatcaaaaggaattacataatggcattcacagcaacctggatcattgctctaaatgaagtaactcaggaatggaaaaccgaatatcatatgttctcacttataagtgggagctaagctatgaggatgctgtactagtccattctcatgtggctatgaagaatatccaagactggatagtttataaagaaaagagttttaattgactcacagttccacatggctggggaggcctcaggaaacttacaatcatggtggaaggggaagcaaatgaatcctacttcacaaggtagcaggagagagaactgccaagcaaaggggaaaaagtcccttataaagccatcagatctcatgacactcactcactatcaggagaacagcatgggggtaaccacctccatgaatcaattacctcccaccaggtccctcccacaaaatgtgggaattatggaaactacaattcaagatgagatttgggtggtgacacagccaaaccatatcagatgcaaaggcataagaatgatataagggactttaggggctcatggggaagggtgtgaggagggtgagggataaaggactatatactgggtccagtgttatggaaactacaattcaagatgagatttggttggtgacacagccaaatgatatcagatgcaaaggcataagaatgatataaggggctttaggggctcagggggaagggtgtgaggagggtgagggataaatgactatatactgggtccagtgtacactgctcagatgatgggtacaccaaaatctcagaaactaccactaaagcatttctccacgtaatcaaaaaccacctgttcctcaaaaactattaaaataaacaataaaaaaccaaaatgccttatcttgcatgttgcaaatctcttaaacctaagtttctctggtctgaggttcttgtgattgttcagagtcctcagatgacagtgatttgcaaagaacggcctctccactacacaggtttacaaaagggacattaatgtgtttttatgtcccacaaagaaatttccctgcttagagttatattccctttcagcgctattccccccgctgtcctaatgtcaaaggaaacctgttcatcagaagagcaaaagaaaataattagagaatggtaaaccatagttcctttcatactcagtagaaagtgaagagaccagtctcaaaggtaccaagaatgtgaagaatttaaacttctggaagatgaacaggataaggaacagggcaaaactggaattctgaatgaagaaagaaggaaataattagaggaacacactggagagatttcagacttgagggcaaaacaaaaaaaaacatcagggacctacaaagaatgactgaatccagtgtcatggatgggaaaaagtaaactggaataatattacgagaaagtaaatcagtgagtcaaaaaatggctaaagataaaagaaaaataacggaaaaagtagattaaaaatagaaaagaaattaaaatcaggaaaaaaattatcatattcttatattttacttgactttctttgtaaaggggggaaactgaaatgaaactattctttatgaaaaccaaataagacatcaacatgcaatgattaatatatgtaatcatagcatgctatgctgaccctgtctcatctatggagaaaatagaataaacagaaaaaaacacaaaccaacaacagacttcaaatactctggcctttgagagacaacttctataaaatgctaatttctttttttcttggatgagcttgtgagaagagggaattaaatctcaggtatccatttgcagcttatctgtggtaaaggagcgtacaacatccagagggcagtgctgtcgcgggaaaggagctgaaacttgttgactgagacactgtgcctcctaaagtctaaccaacaagtgaccaggcactcagccagtccaacagatgggcattagccctgaaagcaatgtgaccatgtatgttcatcaaggttgttttctatagaacaaaattttcacccacaattgttccaacagctgttcacactgagcttatgcacttccagttgggaagaaatgtcattgcccattcgtctttgagtgggataagctttccacatgaaaaaagaaatcaccatataaaggggccacttagctgcaacaaaggtaactcttagggcagacggagccatccaaacctcaagaggagaccattctcttgaggtcactttccagattgctgacagaaaggcatctcagatctctggtactctacccttcaactcccaaagcactttgagttctttccagtagtttttcatgtgtgtgtaacacaactttcacatgtaattctgatattttgttttacttcaaatgttgatacccataataaggaaatattttagagatcccaaagaaaagtttaggaccaaatatttaaatcatctaagatatcattattcctcatggggactgtagtcctcagaccacacatttttctctatttacctcaaaccaagggtaatgtaggcattgaggtgaaaaccacttatatatacaggtattccaaagcaaaaccaaaccagaataagctggaatgatgaaaaaaagagagatcagaggtggatatggcactaagtgatttcaacatctaaactattcaaaatatttgattctttcatttagctttcttgtttttgaatattgatttacagttccccccactaaggccctatgactaacgttggaatcctccttccgcccttacgtgcagtgagtctcctgtcctacccctgaatatatcttgtttctgtcccttatcttcatgggtgctgccgttaatatgtttcaagccatcataatctaacctgaattattgcaatagcgtttcttctggtcctcctcacaatggtggcctggtagattttagtgattttttctatatgctactgtgtcctgagttggttcctgccggtgggttcgtggtctcactgacttcaagaatgaagctgcggacctttgaggtgaatgttagaactcttagagatggcaaggacccggccgggcgctatggctcacacctgtaatcccagcactttgggaggccaaggcgagcggttcacaaggtcaggagatcggaccatcctggctaatgcggtgaaaccccgtctctactaaacttagaaaaaaattagcccggcgtggtggccggcacctgtagtcccagcttctagggagactgaggcaggagaatggcgtgaacccgggaggcggagcttccagtgagccgagatctcaccactgcactccagcctggacaacagagcaagactccgtcttggggaaaaaaaaaaaagatggcacagacccaaagagtgagcagtagcaaggtttattgtgaagagtgaaagaacaaagcttccacagtgtggaagggacctgagcaggttgccactactggctgaggtggccaacttttattcccttatttgctccccttccatgttctgtttttgtcctgtcagagtgcccttttctcaatcctccctgcaactggctacttttaggatcctgctgattggtacatttttcggagcactaattggtgcattttacaattctcttgctagctacagagcgctgattggtgcatttttacagagtgctgattggtgcattttacaatcctcttataagacagaaaagttcttgaagtctccacttgacccaggaagtccagctggcttcacctctcaccactatctccataaacttctattagaatagccataacatgaaatgtttattactttcttgttatttcacctattcagattttaagctcctttaaagacagaaatagacttttgtgtttatcaacaaagactccagtgtgctgcccattacacagcaactctcagtaaatatttactgaattctccatatgtttcaaactttgacccacctgttggtttatgcacatgcctagccaagccgtttcccaagtgtcaggctaaataattgcttttcatcagcccttctcttgtaacaattctattttaaaaaatacacctataataattaccatatatcaaattcaagtgagtgataactttgataactatatcattatctaatttaatctaaacaacagactataaagtaatctacaggtaattgatgagaaattcttcccccaaagtcacgtaactagtaattgattaaacaaagaggggtttgaccaaagcatgtccctatgactgcagcagccctgttctcatccatgctgaaatttactatttgatatccagaatccccaaagagtgagtttcttggacaagagctgcattttattttctgtatcacttgtacctggtgtatcatccatcatttagtacacattcaggtgaaacttgcttgttgaagaatagataaaagaatgaacaaaagtaccaacagattaatggaatttctgttacgaaagaggaagaataaaagaatctataagttttctggctaatccttccatctgaatgaagctataaaatttaagcagtattcaaacagagaaagaatgccttcttctgaataccagtctccctctaaaccaaaacttttaactttcagcaatctggaggacatcattcatgtagtaatcttaaacacttcatttctccattaaatagtccatttctgaaacatggacctaaattataaaatccatttgcaaatcttctctaggatactagtggactgttggaaaataaccaccaatgaggacttaaaatatgaatggtattaaataagggaacattcatgttgagtcaattctcttggactttgttcgttttacagactattatttcacatttcaacccaaatagaaaagaatatttacatttcaataaacattcttgcttaaattcaaaatctttgaaatatgtggaatgtattccccacattagcacagtattctgtgtctttgtgtaaaaaagcatgcaaattaataaattcaacagtttagaaataaaactttggcaaaatctttgtgcaatatatttgaaaatgagtaattctgtagggttttctattttatgatctttagtgataatatgtagagtgtctgcattaccttctacagttattatttcttttataattagtaatgctacttctgagacaattcttaacatcctactctctggaggccagtaagtataggcttgacagttctatctaattcagaagaatccatcttaattatttatttataaatgtcaatgctattaaacagcaggaagaaggggaagtaatattatagtcttaccaatgctaaagaaatatttaacactaaattatgaatttaggagtaactcatcaatatctgtattttggttttgccattaggcatttaaatataaacattttcctactttcagtcaatccaaattatagcagaatatttctgattaataagaatattcgaccttctttcctaaaagtatttacattgccactttagaattaatagtactctacacaatttggtttgctggatcagccaggacaggttagggtttcctgcactaacaagcaaccccaaaatcttagtagattaaagtaacagtttaatttttatttcttatggtgtatttctaaaatgtgtcattagaggaactcagcttattgtggcctgttaatgacacaagatgacagatgtcctatcttgatatgtctttctgatcatagtggcaagcaaagaataaagtaggaggcagttcaatactatagtcttgatataatacatttcacttctacacaggaaccattacttagaactaattgtaattctacccaccttcgaacatggctgagaaaattcttccatatattaggatggagaggagaacaagatatagacgaacattagaagtttctattacatttgcaagtgtcaacttgaagtcactctgtattttttttttacacatacaaattggaatttccgatttgcaggaacagttttctttcattggtttgcgtttcagatttggccccagtgtagatttattttcaggttcttaagccaaatacctgttcttttttaaaaaatgattactatgtatttttttatgtgtctgactccatcttgtcataaaatacatttcctgttgttctgcatcataggtaaaatgtgcaatactcccatggcttgctttctcaaatttctagcttcatattaggttctgcacaaacagatatcaggaattcctaacagctatataaaattgactgctataggagtcttgaaatatctacatttacaacaattagaacacaggattaaaattcctacttgatgtaccccaattgttctaatatttataattacaagagattctttgaaaaatttgacacaatattattgtcacttctctaaaattatataaatagattttggatcttaatgtgtgttttcatatttaggattctaagcctttaataagctaggaacattttaatcatttgatttttgtggcatttcgatctttttgttttgttttttgttttttgttttgtttttgagatagagtcttacctgtcgccccggctggagtgcagtggtgcaatcttggctcactgcaacctctgcttcccaggttcaagcaattctcctgcctcagcctccagagtagctgggactacaggcatgtgccatcacactgggctaattttttgtatttttagtagagtcagggtttcactatgttagccatgatggtcttgatctcctgaccttgtgatccgcatgcctcaggcctcccaaaatgctgggattagaggcgtaagccaccttgcctggctcatttttgatatttttatgttttgaatgattaggtacaccaagtatcgtttttgaaaaagcctatgaacttacatagtcaacctaattaactgatcgtcctaagactaaatttctctactttatttccaatcatattatcttgaagtacctatttacatgtgacaatttttaaaatctatatattattaaagaatgaagagaatctagatatcacctttagttataattcatatgagtaatatgacacaaaatctctgaaatatgcaaatgcatttgtcaaactaacacagaactccatttttttctttttgttttaaaaagtggtctggtggctgggtgcagtggctcacacctgtaatctcaacaatttcggaggccgaggcaggcagatcacctgaggtcaggagttcgagaccagcctgaccaacatggagaacacaaaaattagcagggcgtggtggcacacacctctaatcccagatagtcaggaggctgaggcaggagaattgcttgaacctgggaggtggaggttgcagtgagccgagatcgcaccattgcactccagcctgggcaacaagagcaaaactctgtctcaaaaataaaaaataaaaaaagtggtctggtacattcttttgttgttgttgttattggtatataaaaaactcagtaaacattgtcataaaaattcatataaataaattttctaaaaatatattttgttttagttccaaggattttggaataagggagaaaaaaattctgcattctagaaagcctgactggtagcaatgcaccaaaactcatatgaaatgaaggatttccctgagaagatgacacagcacattctgagtcaacctttgagacttttaaatcttatttttgtcatagcacacagtggctatgcaatgaattgtatctgagttgttcatttaaacaactaaaatagatagattgacctgcaaatggctttctagtcaactgtgaaggcaggctttcattaatatatataggcagtaatttagcctctgcctcattaaatcactaagcaatggttttacgtatcttatagaaaaacagtccaaggcttagctagccaaagatggaaggttgattgtcctagcttgtatcaactcgtctagtccaggaccttgtataatatgatggtcattttaatgtctgctagaaaaattaatgaatcactggtaaaaacaaaaatcattgtttgctcttattttaattgtgaacattcagattttgtgcttgaccaatatgtacaactaaggaatttttcattataattcttaaagtccagcttcataacacagaaacaacttttttttttgagacatagtcttgttccgttgccaggctggagtgccgtggcatgttctcggctcactgcaacctccaactccctggttcaagagattctcctgcctcagcctcctgagtagctgggattaaaagcacacaccaccaaacccagctaatttttgtatttttagtagaggcagggttgcaccatgttggccaggatggtcgacctcgtgatccgcctggcttggcctcccaaagtgctgggattacaggcgtgagtcaccgcacctggcccagaaacaactttttattagataacagcattgtcaggattataaaggaaattttaaataaagtgtgaaggattataaagaaaaatattaaaacattaaatccttcacaagtagaaaaatgtaagccaactaaaaattttgtgttattttataaaaatgagcacagttaggaatcaacataaaaatctctgacatcaaatgcaagcatcttggtaagtatgcctattggtttacttggtgcttatttataaacagaaaattgaaatgttcttagtcatttctttatcacaactaaaatctttcttctattctttcccttcgtgcatctacttctatttttatcgctaatttatttgaactgagtatgtcgagaagtaattcaaatatatacttaaagtataatgaaagtattataatgctatattagcatggttatttaactaaaaaaattgtatttaaactttctttgcattctacttcattcatttatgtgtgttggtgtgtgtctgtgtgtgtgtaggcatttactttcacttatttacatatattactgtttctaactgagcaaaagtaggcaatgttgataaaattctgaagatcttccaaggatttctaataaaattattttcacttaaaacaaatcatctttattagttcctgaacctcctctgcatacccatgagcctgatatagcaaagagttgaaaacctaatccttgtttaccatgaccatgaagaaatgaacgttcttctttttttttttttttttttatactttaagttttagggtacatgtgcacattgtgcaggttagttacatatgtatacatgtgccatgctggtgcgctgcacccactaacgcgtcatctagcattaggtatatctcccaatgctatccctcccccctccccccaccccaccacagtccccagagtgtgatattccccttcctgtgtccatgtgatctcattgttcaattcccacctatgagtgagaatatgcggtgtttggctttttgttcttgcgatagtttactgagaatgatggtttccaatttcatccatgtccctacaaaggacatgaactcatcattttttatggctgcatagtatttgaacattcttaacactgcatatttcattcaaggtgcctgtagcttttgcccaaaagaccagtggtcctaatcatttaaagataagtgacttatttactttaaaataattttttaaaatagtaaacaattaaaagtcagaaggattatcagtgctaattagaaaaagattcatgttccattgcttgctcaatgttacaatatcatggggaggaacatattccattcaaacaatttttacttagcaatattttcataagatgttttgcatatttatgctatatatgtctagtcaattttctttctcatattgaataaacccatctaatgtatccattgttttcttgttacaaagattattactatgaggaatttgtgcataaagctttcccatattttatatttttaaaatggcttctgagaaatcaaacattccaaaggatatagatagtaattataatctattgagattttactatgtgccagtatgtgagacaaatatttttgacatttttaaatgtatataaaacattgtaaattaagttctagtatcatatccattataaagggagaatttaaaaattagagagatttatttgttcagaatcaaattcctagcaagagggagtcaatagttaaagtcatgtctgatattttagcactaattcttaaccaattcaatagatacagtgctaatagacagtgactagaaggaagatgagtagctttcttccagttatgtttccataaatgtcttttaatatatattatacatcaatggaagcataaattttggttataatacttttccaaaatccagttttctgaaatgttaggatatctatcaatctctccactactcacagtagtagaactttacacctagcaacattaaataaaatgaagttcccatcaaataaccttgaagttgtgaacaatacatgcacaatgaatttatagcgttaaaagtcaggatgtgggtactcccagggttgggtgataatgacagtgcacccaggcagcttgtggagcaatggtaaagttttatttctcgatgttggtatatagttggtgaagtttgtcatgctataccattatgattcatgcatgtttctatatctttgttatacttcagttaaaatttccttaaaaattagtagatgcacagctgtgtatgttttagcttctggaaacagcagttaatgctggaatgattgatctacatttttaattctggaaattctaacccctttcttaatctgttggaccagaactagtcactgccttagtcggactccccaacatctttctgtaagtgtacttaatttttttcctgtgatgatccattaattctgatcacggtactggcatgtgttagaggtagcaaattgagagaaggagtgccagaggcttttgactaaattatgcttcacatgtttagttttcatgagttaaatttggtttttactcaactgatggttaaattttagtggggatttaaattttaaaagaaacacctccatgtagtaagtaaccatcagttaataggataggatgtcaacactaatatagtcacccagcttataactatataggtatacagaaaacaaatacacatggttgtcattacaagagttattcaacagataaagcaaataatcatccatttcaatgtatatttaaacactataaatactgaaagaaaaggcttatacctaaattaattcatgaagtaatacatctggactaccaacccagatattttctcttaagaacagaaaattaaactgcagcaagctagtattattgcaatgtggagtggccagattggttacaaaatcgaaaggaaaggcattgatgactacgcttcagtctgcacatttattattttgaaatttacatttgttcattcgattgcactcaggtataaaatctatttgtacctataattacaattatatagctatttgatgaacagactaagtttggctttagctataaagtcaggcttcttaacatgttttcagagcattcatggggccacagtatcctggtgttgaacacataaagaaaatgtaaaagaagaaagtgtaaaagaaaaaaataataagataaattttgtctaatttttacaccctctttgtctcatctctacagccctgttgatgtatgatttttctctcaaccccttcattgcacttgtaacaggggtgtctcatttattcagcctgacatgctcaaacttttgcaaagggagcacgtgagtgagtgtgggatctggctgactgctttgggtgctggcaggagcaggctccgtgtgggccctgtggcagtgcccaggtgagggtgtctgtgcccctgaagtcccagaaggcatgttacaatgctctcttagctccgccatctgtggacagcggtgtgttatcagcttagtaggctctttgcattgttgcgtggggcagctgccctctgccagcaagggcaaagggccagtgtgacagccttttttgggtacctgcactcggtaggtcccgagctcttgtccagagtccaagaaaaatgaggttgcacggacacttgaaggatggtggaaacggagaattttatttagtggtggaaatggctctcagcagagagaggagctaagagcaggggcggggtgggggcgggtggacaggcaggtaatcttccctgaagtccagctatccccagccatctcttccctgtagtcaagttgcctctctgaagttaaggaatctccctccaaaatccagctgtccctctgaagtcaagtcacctctctctagtcaagccacttctctctctctctctccttagtgagtctagggtctttttaggcacaggatgcggggcagggtgagccataggtagttttggaaaaggtaacattcaattggtaagaagacattattcagaaagaatcaactggaagacagcaggcaaaccgggatagaagttctcactttggaccatgggtttcaggcttttttggctcaaagatgggctttcgtcagggacctgcccctgtctgcctattatttttctgcctcctgcctctaccactgtcactgggcctgaaatttggcatgtgtgcaatgacgcctgatgtgtctgatatgcttcatgtaagtagttcagttatgaccaatgtatatatacattggggcatggatgcaataagtgtaataggagtgatttcatagctataaattaggataaactgagagggatattatcatttatgaatagattaatatttccaaagaacttcactctgctggagtaaaaacacagctttatattattattaaaaattcagcctcctgaacaaaacccagaagtcatgagtttgtttgtattatggaatagaatgagatgtactctttattctgataataatgtaaatatatatctgcatatccaaaaatgcatttttcaatcttgaatcgtggtcataaatcatattattttaatatttctattttgatataatgtctggagaaggaaaaataatacgaaatgagaattcacaacattatgttcaaacctttggcaaaaaaaagaaaaaagaatgaggcacatcactatcttcagtgaatacattatttgaccttactggtttgagattctctatacatttcccaaaaataaaaggttatgattaaatatgatctattctctatatcttaaaagattatgaaccaataacaattattaatataaaaagtgccaatatagttaatttttgtgtcatgtataatgaccatatatttgtacaaaaaataaaaaaagacattaaaacaaaatattgtgtgcattttagtacaccatatattatttcatatgctttgcttttgttacccaggctagagtgcaaggacacaatctcagctcactgcaacctccacctcccaggtccaagcgattctcctgcctcagcctcccaagcagctgagattacaggtgcacaccaccatgtccagctaatttttgtatttttagtagagacgggtttcaccatgttggccaagctggtcttgaactcctgacctcaagtgatctgcccgcctcggcctcccaaagtgctgtgattacaagtgtgagccactgtgccctgctatttcatatgctttcatattaaatttacattaagactcaaactttatagttaaagaagcagaagacagaggaatacaaatgatctaaaccttccaaaagaatttatgaacctataatagatgctatgtataaagcaacttggagttattatttatctaaattatgcagattttgttttggtaggttgttaatgggaacaagtgtcaattaggcaaatacctatcttattgcttggatagttaagatctgaattgaatgttataatatgctgtacattaggttaaccaatagtagtgaagcagtacaccattttggctaaattctctggttcaacaatttcaatcgcccatgtagaaatgtgctcttgatctgactgatctgagggatcaagatgataaatatttgttgatgacaccactgctacctccaaacctccaataaactttgtgtaagaactgccaatgatacctaattgcatcttactgacctaaaaaccatctatcttagcaaacatgtaatttccactttgtaagcactgtcagcactcactgaagcattacctacacacaatgacatttgatgtcatgaattcctagaactaggtatccaaggagaagctctaacaagaaattcaaaactctttgccaattataaatagtaatgtaacatattatataattagttacagaatcagaacgtgagtttctctctgaatagagactggctcttgtctttgtagctatatcattgtgcctggagcttgtcaagtatgcaataaatagtgggtaaattgaattatttcccagaatatttgcaaggaatctaaatatattaccatatagcaatatatcagtagtcttgacaagccacatttgcatccattcaaataactgctgcttttggaatgtgtgcattttatttgcgcctcagttttctaatttattttaaaaatcacttgaccagataattttaaatatcctttcgattataccttctaaaatcatgccacaaagatatttccttcatgattcctgtttttttttatgctgtcattggtgcattaaaatgacaatcttatcttagattcttatttatggagcaggaagataaatgtatggcaagttaccaaataaatgacattcccaagtttggaagtcagccaaacttgcttttaatccaaattctactcagaatgtatggggcattagggctatatttatatgataaaaaagaagggtcctctttcttgatttgttccatgccctgtagatctgaaaaagcctgaaacatcatttctaataagtaatatttccttcatagtaagtttcccagagtaatggaatatacatatatatatgtatattccatctatatataggtacagatatatgatatatgtatatgtaaatagagatgtgagtgtttattgtatgtgtgtatttgtgtatgtgatacccaacggtgctcatataaggaaaggaatattgcaaaaaaacagacattagtgaatagatcatcttttggtacagaagtcaaatatttgaagtctgttccagtattcttgtggacaagctttatgaccttcaacaagtcatccttatttattagatacattctgatacacataagatgataatatactctttttccaaggttgcaaatttcatttcccaaatgttctcatcagtttgtctcagacactttttctgaatcagtcatattacacctctcgacactccatagactgcttggttaggagtgtaaccaggcaaagtctgcaagtgtgaaaaaacaatcaagggtgagatgggctatgttatcatggtgggattaaaacataatggattacaattattgaactccccaggtttttatttttaatttttatattactcctttctaatatgagttgtgtacatttgaatgttactataattattttttgttaaattaaatactttcagtgtttaattaaaccaaaagtatttaatttaaccccacaatattatgatcccatattctacactacagaatttgttgacccacttactgcattatggcagagttttaatttagttgcctaagtaatgtttaagttaaactttctttttttttttttttttttttgaggtggagtttcactcttatcacccaggctggagtgcaatggctcagtcttggctcactgcaacctccgcctcctgggttcaagcaattctgccttagcctcccatgtagctgggattacaggcgtgtgcctccacacccggctaatttttgtatttttagtaggacgatgtttcaccgtgttggccaggctgctcctgagctcctgacctcaggtgatccacctgcctcggcctcccaaagagttatcatttttaaatgaataacctagaaaaattatgggtataactttgtctatgacaattgaaagttctacatttagcatctaatttaggattaacttttgacatgagtgaagcactaagtctagagaaccatgtcgcgatgaaaagacggaaaagcaaacatggtaagcagctcctctccggggagccagagtgtaacacaacgagagaagtgagtgaagcaaaaaatcataaatgcctctgaaataaaaaggctagaaatagatacattttattttgcatcaccaaatattgtttcctttacataagtttcattgtttgtgccatcaacacaggggctgtctgtcacttctacgatgtggttataaatgtgaatgactcacctcggcccagtgactgcagaggactccctcccatggtgaggcaaggatatcaaataatgcttccacccattgtgtgggcactgggggcagtgcacagttcctaaaggtgaactgtgcaagtagttaacagaaagctctttgatttgtaaaatgaagataataatatctactcatgtgattttatgagatttaaatgaattaatatgtgtaaatcacttagaacaatgtctggcacatagcaagcatcaggtgataatattactattttgtgactgggcaggtcttcttcatgctgactgagaagtgttcactttgattctaaaagcagtgggctatcactaaagattcaaaaagaaaagagtgatagaatcaactcgaaattttagacatatccctctggctataatatattgaagagggccaaatctggaggcagaagggttaggtgccattcgtacaatgcagacataagatgaaaaagacttaaactagaataatggcagcagaactcaagatagaggaataaattgaggacacagttatgagagatgaacaacagaaattgaagtaagatttagagagaggggggatgcaataaaattatgtcttggataacctatgcagggaagacagaattgagaatcaatctgcatggggaaaaaaatgtgtttgcttttaaattgagttttggatgccttcagagttttatattacaggagaccaataggcaggtgttttttggcagattttaagcttgtgaaagaaatctggcctacagctatagatgtggaattgtttggcatatagacagcggtagcaaccttgacaggggatgagattgtctccaagggagaatgcttaccgtaagagcagaaaatcacccagggaagacacctaagtaaaaccatcacgtaagcaacaagaagatattgagaacaacccaaaaggaaactgagaaggagaagatagagaaattggagaaaacaagaaaagtacattgtctcagaaacccagcagagagaagtttgattcgcaggaggcggtttcagtatggccagttactaggtgaatgcaaccatgaatttagacaaaatgaagactgagaattgccctttagacttaagaagccttgtggggagcaggggtgttaagaggaagaattaatactacaatgtgttctaaggggagtacgaagtgagaaggcaaaaacagcaagtagagaagtttctcaaaaagcttgtatctgagtaggacgatgagatgtggcagtggttagagtggaatgcaggggcgtagccattgaactttgctctcacaaacatctctctctttcttggacacttcttccatattcatgtgtaaatgagacaattgatacaaaaaaccatctatctacccattataagtattcaataaagattagttccatcattcacacagtttgatcttggcaactctggctgccccgagaactttttagggatctctgaagtcaaaactatattcataaaaatgcaaaaacattatttgtctctttcactcctaatcttacatgagagcaaagtgagtttttcacagtccatttgaagcgtgagatgcaataggctgaatgtagaagcagacataaaaatctacctgtcatcttagccagggaggcttgcaaagtgtaaaacagtgtaagtcttctcattaaatatatttattctgtaaaatctaatttttataaataaaaaatgagtttactattgtcatttcaaacaaatttatgactcacttttaatattctccattaaaaaaaaaaaaaaaaccgtgtttctctgtgttgcccaggctaagggcaatgattattcacaggtgcaataatagcatactatgtcttggacccatgggctccagcctcagcctcctaagtagctgggtccacaggcatgtgccctcactggcaatattcttcattttaatttctcatatagtaaatataaaacagaacaaaaagtctttgaaattctcaatattttttttttttcgagatggagtctcgctctgtcacccaggctggagtgcagtggcacaatctctgctcactgcaagctccaccttccaggttcaagccattctcctgcctcagcctccagagtagctgggactacaggcatccgccaccacgcctggctaattttttgtatttttagtagagacagggcttcaccgtgttagccaggatggtctcgatctcctgatctcgtgatttgcccacctcagcctcccaaagtgatgggattacagggtgagacacggcacccagcctgcttaattctcaataatttttaagagtataaagaagtatggaaaccaaaagtttgagatcttcctgattcgttggcactaaaattattagttcctatcattaagtgtttcctaaaactgagtatccaggtttctgtaaagtaataagcaaaataaaatttgaacatagactttaatcctgaaagaacttttttctatttttctataatatatgtatgccttactactgaatcttccatgtttacttatatttcatgtctaccagatgaaataaaaaatagatgatgctttataattggtgacagcaaagtctcttcaaaatactctggtatagagtgtttgttggtatagagtgcaaatagattattaaagtatgtatttattgattgattgtaaatttgtgaatagaatattgttggatgaaagaatggcacttgataaaccatagagaaggactgaagttcagcaatttcttgtaatgcatctggacattatttcttaaaacactataaagtctaattttacagaattgacttgacaaggaatataacattgtgattaggatgaaaattgtttctgtctctatgtaagtgagcattgatatgttttcattttaaacttggaaaaaattgatttttttctttccctatttaaaataaaatgcattcccctttccttttcacatgcgcctcaattctatatagtggttctttgaaaactaattttttgggggatacccttttccctataacaagatctagcctttttgtcaataaaataataattcccaattaattagcatttttatgttgatggtctctagatacctcgtagaaaattaggatgcattatgaaaacaatcataaaacctgtttaataattgttacaaatacagttttttactatagatgttagtagtaaaataatgaaaaatagtagcaaaatttggtgtagtctactaattctttttacttaaaagttgttactctaaaaatcattctttcttgttttacacacacaagtaaagcaatattttctaattaagagtacatttttttttacttgacatctccacttggatagctaattggagttttaaacttcacatggcctaagaaaaacaaattagtttgttctctggctattctcatccacatgattgcttacgctaaaacctacaaaatatcttgattcctgtttttttttttcccaaaatttaattcatcagaaactactgtccactctaccttcaaaatacactgtcatcccaatcccagacaccatcacttttttgtatttcaatagcttcctagttgtaatctttgctgtcactatttactcattttgcaaaacataaattatcacccctcctttctgatttaaaatagttcagctgcatcccagttgcatgtaaaagccaaactccaaacaacagtctgttgggcctcccaaaagcccttgcctcctgctctaagttaatttcccactaactgtgtcttcatcttattgactacactccagccattatggccttcttttgtatctttattcttgaattctggaattctttttgttacttttgtctgaaatttctgttctcagctctctacttggcactgtctttctcctgtctccactttaatgttacttcctcaaagaggctttccccggttctcaatatgaagtcatctcagtcacagatattctctaatttttcatttgttttcttcataattttaaacattacttgaaattatcttgtccatttttgtttcacttacaatttcccctctataatagagtacaatatctgagagtataggccttgtctgttttatttaccattgaagccgtggcctaaaatagtgccagacatacagtacacaataaatatttgctgagttaacaacagataaaaagaataaatgtttttatttatataatgtgtcaaagaatcaagaaaaacatgatataaagttgttttatgtgcatgaatgttatgttgaattttgcaatttagtaaaccacccagcatttcaacatttttagaaattagtgaattgacatgataaaccaaataagcaacatattcagttaaataacaaatatgttaataaattgatttggctatctttttcttctttaagatgcaaatgaaacttacagaaaaaaataaccaatatgaatttctgatactggagatcattctaatcaaacacatttcaaagataagaaagaattatcctctgagattattttgatgcacctagataaaattacagatgtaattgcctatctaataatttatgataactacttatatacaagttttggctattctttatattaaactcatatttttttcagtgaattttattgacaacagaaaaggatgataggctggatgtggtggttcacacctgtaattccagcactctgggaggccaaggcgggaggatcacttgaggtcaggagttcaagaccagcctggccaacatggcaaaaccctgtctctactaaaaatacaaaaaaattagccaggcatggtggtgcacacctgtagtcctggctacttgggaggctgagccaggagaattgcttgaacccgggaggtggaggttgcagtgagctgagatcatgccactgcactccagcctgggtgacagagcaagactctgtctcaaaaatacgtacataaatgaatcaataaaatataaaggatgataaaatgattatgaactgtcactacagagtttaagcttacactgtgtataccatgtatacacatactatataatatataatatatatagtatatatatatactatataatatataatactatataatatatatattatatatattatatagtatatatatactatatactatataatatataatatggttccatgaagaccaagaaactaggagtaaggtaacttaggttctcattctagtctcactactgtgatttactagcaaatttaacatatatggataataaacgtagatatagaaataactgcatataacctgtatagtgctttctcctagggaatagaactactaggggtgggttaaaaatagcaatgtgaataaaagactttcattatttattgatatgatgtatactatttatttttatttcaacaattatgtattttgttggaaagaaatgagaaaaagttaagtccagattattttaatgtggcttcttatttaaattatgttataaaccagaaggtagactgtgataaattgaagctgaataaaatcaatcctaaagaaaccactaaaataaccactcaatttgccaaccaaggagataaagtagatttatgacaaatattttttcaatccaaaagaatgcagacaaaaatgaaaaggggaggaaacagatgggaaaatagaaaacaaatagcaaaatggcagacacaaacctaacaatatcaataatcaaattaaatgtaaatgggttaaacaacccaattagaagtcagagattgtcagagtgaacaaaaaagtaagactcagctatatgttgcctgcaataaaagcacttttaatgtaaagacacaaatagattaacaggaaaatagtgaaaaaaaagtatagcattctaacaaaagtcaaaagaaagctgagatggctgcaattagttttttgttatgagtaatacagatattaacactcatctagacttttttgttgacatacgttttacttatattaaataaatacctaggagtggaaaatttctatattatagatcttacctctagaaattaatagggaataaagcaaattaaattcagaagaagaggaaagaaaataataaagattaatgtggtcattagtgaactagaacacagaaaagcaatagagaaaaaaatcaataaaaccaaaagctgttttttagcaatttaaaaaaagttcatggatttctagtgagactggtcttgaaacaaaaagagaagacacaagttaccaataaaagaaaaggcatcacttcaaatactaaagatattaaatagataggaataaaatattatcaacaactctataccaaaattcaactatttatacaaaatgaaaacttttcttgaaagacacaaattatgaaagctcactcaagagtatactaacctgagcagaacccccacagaatccataattttgatagattttacccaatatttaattaaaaagtaatacgattgaataaaactcttccacaaaaataaaacagagacactactttgcaatttcctttatgaagccagaattactctgataccaacaccaaagatgaatacatataaaaacatacgtagatataaagacatatatatatataaagacatatatatatacacactaatatttcacgaatgggtaactatgcagtttgaagatcagaatcaaaaagtgctcatctaaagtaacttagaagatattgggctctggaaattgactagatacccaaaaagtatattttataatgataaatacactactgaaaaggatgctgactttttcatgaaatgtgagtagtaaaaagtaatatttataaattaacatttataaaatgtgtgattttaagtatgtatattcaattgtcacaaattataggaggacatttgatgatttagtttgtctctctaaatactaatttcatcaagtcagctgatttcaagtttcataaagataatgggaatattcccttattctctcgataaccttatacttaacaatacatcatatttctcttagttatgcagatgaacaaattctctctgggcataactgtgtgttaacaatgtcctataatctttaccaaatctgtgcctcagcatcagagttcaagtacatatttgagatgcattttatcctagctagaaaatctaatatgtcttaaatggatcgatataaagaaacataaaatgctaaactcaagtgtttagtgtttctgcagacattattaatgactggatcacattagcataatcagttattctcagttttcagccctaaatttttctttaaaccatgatcatattcataccttacaagagtgccagacacatggtagtttgccaatccactattcagttgagttaaatcatctttttaaatcaccaaacactttactcagactttcatttccatcactataaaatatctgaactcagaccaaatcaacaacatttagagtagataatctattagtgcctattgcaaggtccaatttaaagctgtacatataattaatatatatcaattaatcttcacaacaaatctaaaaggtagatactatcatcccatattatggatgaggaaattgaggcacagtatttaagcagcttgcctggagtcacgcagcctgtaaacagtgcagtctgacgctagagctcacacagccatagtcacgaggcatatagcctgctggctagagcggctcagcacctacctgttccctgacagccaggcagcaaaagtgcctcacattctatcttggtatacttgtaaagtgcccatgtcctgggccttcagggtagcttacaaacagaaaaatgtcaactctgagaaagtgagagaacacttttaagtgtatgtacttgctgaaatactcctagatgtcgaggcccaaaagacatatctcctatctgtttctcatattctattgtatttgagtcagcaaaaatgtatagtatacaagggcaaagagtattgtaacaaaattttcacacttgcattttaagtgtaaaaagtctacattgcctgagacaagaattctaaactagtcccaatgagatttcatagtgataaaactgacacaatgtccaaatctgcatttccagaatagctcctcctcaccacaacgcatgcacatattactgccaaatcagtacacaagtttaacattagtcttacattaatagagatctgactgattctgtcgtttgttctgcaaattgcaaatcagccttaactaacaaaatattcattattaatactagtaaagaaataccctggctctgtacaatcatttattagatactgtgtgctcatatctttacacctgaaggtcagtaaaaattttacataagggagcaggagaaaaaaattgaataaagtccctctatatagaatgttagcacattgtagttgctttcctcttttaatagctaaagggagaaaaagaaattttaggtaaagtcttattgagctaagaagaaggaattcaatagaatatcaaaagaggaggtattttatgtgccaattttatttctaaaattaaaattacacaaccctcctcacccacacacatattcatatacacacagacatattccttgtatgcaaagattataaaacagatggcaaaattagaacttaaaatatcgaataagttaacagtaaattatagtataaaagtttccccaagctagttaatatttacatgttaaatgattaagataaattctttgagtaaggggatcatggaactgggatgataatagaagacaacattattaaacatttaatgtcaagcctgaaaaatattgaacgtaattatttacctcaagatcaaatgccaagcaaatgaagcttctatggaaagaaaatattcagccttccttacctgagaaaatggtcttgttttagaaaacaagattacaattttctttttttacattaatgtacacttctttatttcaataattgcataatacaaaatcaggaatgttatggccctacatctttggaatatgtatttttctcatggaatagaatagcattatttgtatttcatgttctttaataaactagtacaatagtcttcatattaaaattgaagagatttgttattttattttcatgtattttatatttttgtagtcatgatcaaaagataatttttattattttctaaaattctaaataactgttttgggaggtatatgtattttgcatctagcatctttactgactgtcttattaactcttagagctttcttgttttattttaatatctctaaatgatggtagcatctcctttctgtttatatcttttttaaaaaatcattctgtatttaccagtttttccaaaatatttcttttttactttaagagagtcactttaatgtttgctattaaatgtgatattcaactattcggcttttgggctaaaatattcttttcatgttaagaaattatctttcatctaaattcatccaggtttacgaagagtttttaatagatgaaaacatggtgaatttttctcgtgtcctcttgaaactacttgaagtgattttgatttttctcctttgatccactccatgcagtatttgattaataggtaccctgagattatacttttgagagttcttaaataagacaaaatgtatttttcttaatttctgaaatggattgaataacattttattggggaattttgtatccattttcatgttatactggtcagaaattttcttttttatgttgctgtgaatttttgtaatcagtctgaagataattctgtaaataaatgaactgagttcctagttagtctccagattcatatatctggtctttcttcttcatcagtgcatggaactactccagtccagtgtgtccgcgatctgattagtaaataaacccctttcatctttcctgtatttgagctttgtatattgtttgacagtatggaaaaccttttactttttgattcttgatttcctctagactctcttttcttctttgggaatttttgtgaatttacattaaaagtctgttttgtctgccaaccccttaaatatgaatttctcccaaagcacagtccagcacaaattctaatactacttgttctccctgggcaatctcatccaatcccataacctcaatttttggtggtatctctatatttctatatctgtgtctctaaaatgtcttccccctgggttcccattctgcatatacaacttcaccacgaacatctttactgacaaattccagggcatttaaacctcagaagattcttcctactattcctcttttgatgtctctcatctcccatccactctattttccaaggctgaaacctgagttcacttccttcatcttgtttaacccaagcaaatccagttggtgaccaaaccatttgacttccatcttacgaacatttctaacttctgtcttttccgctccatgtctactaccactaagaatccaaattctttttcttcaaatttactagactttcctatcgttttctatcaagtcttcttttctccaatgctctcatgcccaatgtatacttcttattttcacaataataatttgtctaaaattctactttgatcatatcatccactaatatataatacttaatcccttaaagagttcccagtaactcacaagtaaaagttcaattcgaagtggtttgcaaaaatacatattgtaagagaaaacaaatggaagtaatcatgtcatgagtaaaataataattcaaaaattttataatttagaggaaaattaattcatacagatgcagagacagtattcaaatttggctgtaagcttccaagcagccaaaagaatattatacataatattgagacctttttaaataaaattaattttttcttagaagaagtagttttcggccaggcgtgggggctcacgcctgtaatcccagcaatttgggaggccgaggctggctgatcacaaggtcaagagatcgagaccatcctggccaacacggtgaaaccccgtctgtactaaaaatacaaaaaaaaattagctgggcatggtggtgggcacctgtagtccctagctcaggaggctgaggcaggagaatggtgtgaacccaccaggcagagcttgcagtgagccaagatcacatcactgcactccagcctgggcgacagagcgagactccgtctcagaaaaaaaaaaaaaaagtagtagttttcttgaggttctttacttttttttttttttttgtcttttttggtgacagggtcttgctctgtctcccagactggagtgcagtggcatgatcttggctcactgcagtcctgacgtcccaggctcaagtgatcctcccaaccagggcacagctcagtttttgtatttttcatagagacggggttctgctgtgttgttcaggtttacatttttttatttttaatttttgtgggtacatagtaggtgtatatgtttatggggtacatgagatatttagctacaggcatacaatgcataataatgacaacaggtaaatggggtatccatcacctcaagcatctaacctttctttgtgttacaaacaatccaattgtactcttttagttactttttaatgtacaataaattattattgactgtagtcatcccattgtgctatcaaatgtactgtatccaaagagaaatttctctcatgagtccacacaaagccaaagttatgttatataacggtcaatgttttcaaaatagctccacaataaaatgcaatgtttggtatgacataatgtcaatgtgaaattctctaagaataaatgatctcagaaggagccaaggcaatgtagtttaagtacttggcattttggttctctgatgagccagtttaatgcagggataaaatgtaatgtctttagaatattctgtaggacattgtatatatcctgcaagcaatgctcaatgaaagttatcaaacttttattaagatttagacagctgcaaatatggggttatactttccagcagctgcctgcagtacaaagtttttatggttttaattaaggatggatttattgtccttgatgttgaacttgaaagtgtggtaagatttaaaaggacacatgttcttttttttaattaggaagacaaattgacttgtatctgaacagattactttttaattccctacagaatgtatcaaagtgagtacctgcagacaaggtcaatattttcctcagaaaatagtttggggttattccaacattataattagtaaattggaaaaaagccataatatacaaaatatgaaaaatagaaacaagaaaggcataaatgtaataccttacagaagtaattaatgatgacaggcatgtaggttctaaaaattttcatgtattctccatcactttcttatttttctactgaagtattttcttctttgtttcaaaatctctaaaattcaacacttctaatccatgtgtttttctctctcccattaccttccaagatcagtacattgaatttacaacaggtcatcaactttcttgcaggcatggcagatgtgagtaagctcacagacattaaactccctatttcatggttcacaaaaagttatttctatcttcttaaaaaacagctaatggcaagacaaacatgctgctaccaggccatgctgtgatgtagtcaataaatttatttacataaactttgctaattgcctttatagcaatggccaaaccattaagaggttgcctcatctgctgggagactattgaggaaccttaggtttatacctttctaggaagaaaaaggaaacaccattcctttagaaaatttgccttagtttccagcgtgatggtgtagatgatttctgacttagtgcatattgattattaggatgaccaaaatcccaaagtagctttgctactctaagctaaaaataatgctcccaaatgcaatgtaaagattacgtctatactcatgaagtgaaagctatatattaaatttgaaagaacacccaatgttgttactatatttaatgtttggaaaataagttcttagattatgttttagactgaaaaacaaggtttccagcacacagattgaaaatatcactcacttatttattgtcctagatcatcctgctatttctatgtcaaaggcttgatatgagacttagtatctaaatagtactattttaccaaccatatcaactagcttgttttaaaagttgtttattttctaagtcattgatgagagctatagtcttgtgttaaaatttttaaagagtatacctcacaagacacactctgtgctactagccctttaaacaaagttcatgccatatgacagaaataaataatgggtttgcaaattacaccatccaattggtctcctgcatatttggctttgtgtccttggagtgattttcaacatcattaagtgaaaagcccatcatttcccaagtaacaagggatgaagcacatacagagattgacttggcgtgtgttacataaactttctgttttagatttgaagaatttacataacaccgaaacaaaacaacaccctgcaaacatatttgtacagtcagttaaatttctctacagtcccattctatagtcagccctgccaaggttactctggctgttaaattttatgacataatttttaatacagtaatatttttcacttaattttttaaatttattgatggtacttagaatttttgtcctgcataatagatgcctatctgaaacttgggaagacagaaaattatttaacatattagaaactatttgtacaattgttctgataatcagtaagttttgaaatagctacaactctcctagtccaaaattaatttcaataaaattatatgaaggcattatttccatatgtgaatcttacttttttatatataccatattatataggctgctatatatagaaatatatgtatatatatgcatatatatgtacatacatacatacataaacatatatgtgtgtatatatacatattcataactttttccttggagttactcgaatatttgacactcaatccaacaaaaaatatatttaaataaaattttgaattatatattttgttactggaatattgaaggatgcctcgacctgtattgacctatttgaagtctctccctgtattgacgtatctgaagtaatataaaattaggtattttttatttcagactagtattttaaagtcaaatgcaccattcctaatatggtgacactttaagctttagtaattgaaataacaaaaaaatcatcaggaagattgtgtaccctgtgggaaggaaaaatggaacacattgtcaaatgcttgagggtatttcctccttctgctttatgcagatcaatttctcccttgcaaaattatttttaaaacaaatagttgaaatataccaaatatactaagggcctttcctttccagagctgacaggccagagaagtcaagacaaaacctaatcagccacaaaaacctcaaagtgggccagagggagaatgtggtcacacttcttcccttgcttatttggacaccagtgaacacacaaggcacttagattgatactactttttgcagactcatagcaaagacaatagggctgcctgtgacaataatccagaacagatgatcatttcttggcatacagttagcacaggagggccctgcctgaggtaccagccttgttttatgtcatgtaaattctgacttacgcatagcacaaattactaacataaagcaaatcagtgcttttcatattttttcctttgaatcacatcaaaaattaaaactattatccacaactgctcccacgcgttttcacagatcagctcctccagagctatggcatttgcccctttgcactcggaacagctaatcttatcatttagtccttcagtatgagaaagatatgcaactggcctgaacactgttggtggatatggtgagatacagccacagaggcagagtaccagatgtggcccttttttttttttttttttccagtaagatcttatggggtataacttcccttcacctctttctgcctggcttgtgcttgtgggtggcctttgtttctatggttgaaagctaagggatggtgggatccaactgtatcacatctgattcaagttggcatttgtggcagtaacaacattctagatggttcagcttcccacaagctattcttagtgaatttccaaaggttagtgaaaaaacaaacaactctccttctcttttttctcctctgatgccagggaaactcacaacaagtcaaaagagcttactttagagtctggatcagtttccaaacaacctggagggttcatcagggattctatgctgtactttttaaaccatttatttggaaagtttgctaaaatctactatcactggaaatctgagtctcagcccctcagcccactaaactgtactcacatatagagtagaaggttgggtacatatctatataatgaaatgtgttggtatcaaaagaatataatataatgaaagtattctaatttcctataaacatcctagaaaattttttctaaaacatactttccttcgttatgttcaaaagcactctttgattttgtaaacatttgttacccaggttataaagagcagaaaatgtttgtcaagacagtttattagctaacttgaaatagttgaaaataagtttatgactaatttcatttaaaaagctgaaaagctaaatcttcattagttcacagttgttttttaattgatcttcatggcccaatatagttaaaataaaagactactagaaagcctatggggtttgaatttatgtaattctagtcaaaattagcaagcttcttttggttttattttattttctgatttacattatgcaggaatgctagtggtctgggacaattttaagggccattacaaatttttatgaaatatttaatgaaatgggaccagttcagtattgttaatgtttacaaacaaaaattagatcttattagaagataatcaaaaattataactgatttagaaaattagtgaaagcttatattcactgctagctgcctattcaaaagctataactcacatattagttttaaagtttgaaccaagcataatgttcagataaatgtttgtttccatgtcaatgacttctctaacaaaagatgcctgcctgagaaaataaggccaatattaaacaattaaattaaacaataaggccattatttgcatttgtttgcctgactatgaaggtgggtcatggacatctggttcatcaaatagtgttcttctagtactgcagacactgccagtatggattatgtgaacttccactactttatctgtatatttaggctcttctttgtctacaatttggagaactttaagccttgaatttcaatctcaccccatttcaaccaattcatttgcttaaccaatatttattcagcatatattccagacactattctaggtactgggtataaagcaatgaacaagaacacacaaatgggattccctaaggaattccttttcttaaggagcttacaattaattgagaagagatggacttacaacagttaatacatagaggacctcaggtaatcagaagtgtacacctggtggtgtgacagagagtgactgatgttaaggcagacaaaattagataatgtggtcaggaaaagtctctgaacagaagccaatttgagatcaatccccaaaaattaccgacatggggagagagctttcctagcagtgagaatgcaaggacaatggttgggaggtaagaatgagcttcgcctgactagagatggagcagtaaatgggggctagagcaagacatgagcttggagacaggcaaggaccagctgtgtaaggccttacaaattatagtgaagagttctgatttgagtgtccagtaaggcagtgatgtgtttcaatgtaccttattagcagtcactttgtaatccaccttgcagactactctaaattttctaaaaaatatttcctacatcgtccacctatttaaagtctcaactgtctttttggtatcatcaagaaaatgacagtatttacagacaatattcttggctttctacagtgcagaggcaatgaacttctcaaatcataccaagcaaaacttccctccatatactctgtgctacatccaaactcttctggtcagggtcccccaaacttaccattttctttcctgccttcatatgtctgtacatcatctttcccctgaacccatccatccattatttctacttcctcaagctcttcccattcagttcctacaaactgaatgcgtatatacctggccaaggtaatttctaaataagttgttttctcctttaccactcatttggcacttcatgaagtgtgtcttttacattttaatacataggaccaaataaaccagctgaaagtttgctgagatcagccagtgattttcaatttcttttccttctcccatcgctagcacataatctttttgtttgtttgtttttgagaccgtgtctcgctctgtcccccaggctggaatgcagtggagcgatcctggctcactgcaacctctgcctcctgggttcaagcgattctcctgcctcagcctcctgagtagctgggattacaggcacgtgccaccacgcctggctaatttttgtatttttagtagagatggggtttcacctggttggtcaggctggttttgaactcctgacctcatgacccacccatctcagcctcccaaagtgctgagattacaggtgtgagccaccctgcctggccgcacataatttttaatacatcctgtaatcccagctattcaagaagctaagctggtaggatcttttgaggccaggaattcaagaccagcctaggcaacggtgagataaccatctccacacacacacacaagattagtcaggcagaacggcatatgcctatagtcctaactactcgtgaggctgaggcaggaggatctcttacgcccaggagttgaaggctgcagtgagctatgatacactccaagctgggcgatggagtgagatttggtctaataataataaaaaaaaaatctaaatacaatgaatgctcacgaatgcttgataaaatattgatgtaactcacctgggttcaatatgtacttcttgtgtgtgtgtgctaaactttgaagcacctttctaagatgacttgttgatttgggatatggtccaaatcaaaatagaatttaaaaaaaaaaaaaaaaatctgtattggaacttagccaatggccttgatctccctgacatcattctctagatttctatctaacaatcctggatactcagtgttttttttacggaagaacaatacccatcaaggcctctgtgaatgtgtctgagatagttgcacctcgagtcaaagaattttgcaaatgagtgggatgagtccacttctttcaggctgtctctttggaacacaaagcaaccacttgccttgctggagtttaaaaataaattaacatggtcagccatggcctttcccagcacttttcattaagcttaagtcaatgaaatagattcaattagcttgttttactttgaaaataaacttaaaaaaaagtcttcaacattgatggctctatttctcatggagtaccaaaaaaaaaaaaaaaatgtcaattttgctgagctatagaaccaagaagtaaacacttcaaatagacccagataccacagaaatgtaaactatctggcactaaatattgaactgacagtagctgagttttttcattttcaattttaaagcacttattagtgtataatctgttgcccgttattgcagcattcacctggaaaaactatggtgatatttggacactgaataaatatacatgttgtttacttaagtaaaatttttatcaacagtatttagactatgtaaaaagaaaccatcctagaaaacaaaaataccttcgaaccaattatgtgcttccatagaaggtcaacatcattctatttagtgtacgtgcttctattaactaatctcaaaaaaaaagcttgaaatataaactttcagaaaaggatcctgagccacagtatttttaaaaaaatacacgcacacatacactcatgtaaaaaaatcttgttccataccctgatttgttttttaatatttttagtaattgctttaaaaaaaaaaaagattaaacataaactaaagcaggtgagaaaggaatgggtttatgttcctatctgggactgggacctgttttatgttactagaaattgtttctacatgaaggtaaatgaaagaaaaatctattctttcatcactaagtaatcactaatatttttttcaagctcatcattagaaacaagatgatgaagtggtcaaatttaactcagctgaaaaataacagcttctgaatctttccttagtgctcaccttacttagatcttctaaagaaacttaggccaaatgggagactttttttttttttttttttttttttttttgctggaaatcaagcttccccatcccgatgtgaaatttacatttatgagaatgcaaagccaaaagcattttataaaaagtttaataccataaagaaattttttaaaatgtgcatttactgtctcttttggctgcactgtatggcattttaggagatacagattttaacatggaaattggtttggatgctcttgcctccgtgattaaaacagatggctaatatacgtatggctctctcagacttaacccccatacctccttctcatcactgtatgtaccaatctaatttttagcaagaatgtggaaggattccataggaagttttaaactcagaaaatgaatctataattattctcagctggtgaacacaggtatgaatcatgaagtaaacttctaactgcagagaaataccctttgtactcaaaattccttaagtggagcgaaaacatttcctacttatatacatacacacatacgtacatacagatatatacatatgtatacgacgagttaaaggcttgcagtattgagatattaaaactccctaaaaagagcagctacatttcgtattatcccgcagtttcaggttttagaaaattaataaaaacataagtagttatacatacttaataaaaacgtaagtagtaatacatatatacacacatacatatatatgtgtatatgtatatgtatgtgtatatatagtatatgtatgtgtatatatatatatataactacttatgttcttattaattttctaaaaactgaaactttgtgggataatatgaaatgtagctgctctttttagggagttttaatatctcatactacaagcctttaacctgtcatctataatcatttgtatgtgtttggattaacataattctttataacttccatatcccagatgtaaccaaaaataaaaatataacattagaggtcaaagtaaaatttttattctaatgttattcacacactttaaaaattaactccatattgtaaatgtctcagtaaaatcaaatactttctcattttttatttcctagaagagaaaacgaaaaacctcaaaatattatttggattttctgcatagagggctaaattattgggaaggatattaagatttaagtaaattgggatgtggcatcagcaaaatggcagagtaggagatcctagcctttgccacccaacaaaaaaacaattagatcactatgcacaaatgaaaatagctctgggatagcttagacgtacagttcatataagaagctgcagcaattcagttggggagggggggaacaaaaacagaataaggtcatggaaaggataggaagaatactttcattattccatcccctactctggcacagcttggtaccaagtgtcctgcaagtccccctgcaggggaaaaggagaacagggtgagcaaacagcgtccccagactttggaagccctatcaaaaaaacctgctttgattttaccacatgcagattactgcagagatcagcatagcagtgatgtctgtagatgcctagtaacaaagagtaaaagccgtaagtgtcagccacatgacagatgccatagtggcctccagttacctgctctgcaaaggactccaacagctttcactgctgaggatctcaacattacatccttgtagctgccatatactacctgtcacagctttcacctctaagactccaaaaattttgtctttgctgaacccagccacaacccaccatatcatcctttcgctttcagcctatgtgtatcattgtatctaaaatgagtcccatggtgggaggggggagggatagcattaggagatatacctaatgttaaatgacgagttaatgggtgcagcacaccaacatggcacatgtatacatatgtaacaaacctgcacattgtgcacatgtaccctaaaacttaaagtataataaaaaagaaaagaaaatgaaaataaataaataaataaaatgagtcccatagctaacatgtcactggatctttattttttatcgatttagtaactttatagagaagtaaaagtatagagtttttgtatgcaatggaaatgtaagtgtttgtgagcttaataggctattgtaactataatatattttgtgtcagcctcatggtaaccacaaaccagaaatcttcagtagatgtacaaaagataaagcaagaggaatcaaagtatatcactacagaatatcatcaaatcacaaaggaagacagcaaaagaggaagaaatgaaataatgaatatagaaaacagccagaaatcaatgaacaaaatggcaacagtaaatccttacctaccaacaactactttaaatgtaaaggaattaaattctacaattaaaagatatacagtgtctgaatggattaaatgaaaacaaaacccaattaaatgctacctacaagtgactccttcatctttaaaaacacacatagggttaaaggaatggcaaaaaaatttaccatacatatgaaaaccaaaataacacagagatagctatacttacgtcagataaaaacaggctttaaattgtaaactgtcacaagagacagcaaaagccattgtatcatgagaaaggaatcaattcattgagaggatacaattgtaaacatatatgaacccaatattggagcaaatattaacatatataaagggaaaaattaacagaaatgtaaaaaagtaaggcatttccatactccactttttacaatggatattcagacagaaaatcatttagaaaacattggacttgaccaaataaagcaaagacacatatacagaactttccacccaacagcagcaggatgtgcattcttctcaagtacacaagcaacattctcttggatagatcatatgttaggccacaaaataagtctaaacaaatttaacaaaagtgaaatcatattgaacatctttctaaacacaatgatgtgaaccagaaatcagtaacaggagaaaactgaaaaattcacaaatccgtggaaattaaacaacatgcatctgaacgaccaatagatctaagaagaaattcaagaggaaatttaagaatatcttgagacaaatgaaaacgggaacacagcatcccaaacttaagggattcaacaaaagtagtttaaagagggaattttatagtgataaacatctacatgaagaaaaaagtgaaaaggtcagagcagaaataaagagactaaaaaaaatagaaaagatcaatgaaactaagagtttctttttgcaaaggtaaataaacttgataaaactttaactagattaagaagaaattgaagccttttaataaatagaattagaaagaatagacattataactgatagcccagaaatacaaaggatcataagagactagaacaaactattatatgtcaacaaattagataacctacaagaaaaagataaatttctacaattatacaacctgataaaactgaatcaagaagaaacagaaagcctgaacaaaccaataacaagtaggaagattaaatctgttctcaaaaatctcctatcaaagtaaagtccaggacctgatgtcttcactaaagaattttataaaacatttaaagaattattctcagcaaactaacacaagaacagaaaaccaaacaccgcatgttctcactcataagtgggagttgaacaatgagtacacacggacatagggaggggaacatcacacaccggggcctgtcggggggtgcggagtggagggagggataacattaggagaaatacctaatgtagatgacgggttgatgggtgcagcaaaccaccatggcacatgtatacctatgtaacaaacctgcacgttctgtacatgtactgcagaacttaaagtataataataataaaaaagaattacaaccaacctttctctaactcttccaaaaaattgtagcaaaggaaacaccaccaaatttattttacaatgccaacattaacatgataccaaagtcaggcaaggacactataagaaaagtaagctacaggccactattactgatgaacatgcaaaaatcctgagtaaaatactagcaaaccaaattcaacaggacagtaaaaagatcacacagcatgatcacatggcaattatttctggaattcaagaatggctcaacatacataaatcaataaatgtgatatgccacattaaagaatgaaggataaatatataattatctcaataaatgcagaaaaggtatttgacaaaatttaacatgtgttcatgataaaaactctcaacaactctcaacatatctccctgttgctgacttccatatatcattccacaagtctagttgcttctacatccaaatagtgtttcatgctttaacttctttccatctttcatttctcacattgatatctgcctcagcccttgaattgctctctctgcctccagtcttgagtctccatgaagccattcagcatactctcaaattttaccatcccactgtaaaattgttcagtagctacccatcatccccatgttaaagtccaaatcccttaatatcacttttaaaatcctctacagtctaacaaactgagtatttatttaggcttatatgcaacctctttccttcctatttaaaaaatatagcaaaagctaacatatttttgttctttgaatggactttccattctgtcattcctttcaccaccctctccttagcatatgaattgcttatggattgggtaagcattttgcttacttgacacagaataacatatcctctagctatctgtgctgtttattttcctctttatattatcaactctactcatccttcaatctccatctatcacatacacagaaaatctttccttaagtctttgagattgagatcctctgctatctgtatttaaaatgtatgcattcctgtagaatcatattttgtcaaattttattttctgaatttttacctgtcttcctttaataattgactcttctctgagaccaggttctgtagttgccttatttacatttatccaatgtttaacaaattacatatatatactagataatatataccttgaaagaaggaatatgtgattgaatgaatgaataaatttcttagaacttgaaagagagaatattgtttatggtaaatcaaaagtctgaaaatagccacgcacagtggctcatgcctgtaatcccagcattttgggaggccgaagcaggtgaatttgagctcaggggttgaagaccagcctgggcaacatggtgacatcctgtctttatcaaaaatacaaaaaaaaaaaaaatatagccaggcatggtggtgtgcacctgtggaccctgctactcgggaagctgaggtgggaggaccgtttaagcccaggagtggaggttgcagtaagccgagattgtgctactacatcccaggctgggtgacatagtaagaccctgtctcatttaaaaataaaaataaaattttaaaagtttgaaaataatatcttttctaaaattcttataggtaaaaacaaattataaaaattaggccagaatcaaaatatgattaaatttttaaaagaatccccttgcatccttaaagaagataaaagataagcagtaactcttgaaaaaatattttttaaaaaaattgttttcttagcatattattgttttcatttacttatttaacaaatatttattgagtgcgtactattacccaggcactatgccatctctttgataaacaacataattagaatgttttgcatgtgttccattagatgatttaattttaaagttagaaaccgtgtgattttaaaaatcagctcagcacatagctaacatgaaatataaacaagatcttacatgatgaaaagaatagctaaaaactactgccttgtatatttagaaaagaaaattacatggtagaaagacccaaaggaatagctaccttgatttaacactgctggaactttcagcatttggctgatgaccagtagagcacattagtattgtaaggccaggcattgaaaagaacactaagattcgcttgctaccttccttacataagccagaatccatgtaccgtatatgaatccacaaaaataataaagggaggtgacccaagagcaatgcttacataattatctccagttgtcatcaaagttttaatttaaagattggaaaaaatggaaaatgctggtctctataatctgagaaagaactagaagggacaatgacacatttttcttttatggacttatgttttatggacttatgacattacatgaaggatttattgttagaatctatatatatgcagatcacatacagttttatatataattatataaaatgtaagaggacagcaattagtctcatattaatattcaaagtgctaacagttaacaccatatcattttactaaaagcaagaaattcctattattttccattcaaaagaaataaaatatttccctacgatagttactcatttggaagacatgtgaaaactggcagtcacttggcttttgaaggaatgaaactttgaaagggttcagacgaattgttctaaatgtagattttaattggttccttcattccccgtgacctataaaatactcagagaagcttcaagcaaaatgtgttttctccccaccctgatccttgccattggcaaaggctgcttattttcttatgtttcaaattatccgagttaacgtgactggctttgtttagcaatgacttcacataactgggccttttatcaggcatttttatataccggcactattcatgttattatcaaagactgaaaaacaacattttttgtaaaagctgagcaaaacaccaaagagtatgatggcaacaataatatatttatcatgagatgctggtaagaagagttaaacaaaccgaaaaataaatgatctagcaaccagaggctggagtgagggtggacagggaaaggggaaatgttggtcaaagggtgccaagtttcagtgagatgggaggaacaggctctggtgatctattgcacagaatggtgactctagctaataataatgtattgtatatttcaaaacagataaaagaaaggattttaagtttctcaccacaaacgaatgataactgtttgaggtgatggatatgttaattagcctgatttgatcatttcacaatacatgtatacatgacattgtaccccataaatatattcaattattatttgtcaatcaaaaataaaataaaacttaaaaataaaattctcatcctaaaaagaatttaaaggctaaacatgagctttcaaagaacatttttggaaagtacgtgtgaataaatattttcagggctagtttcttttcattagtacatgttaagcatttctcttctacaatgtgtttaatatctacacattattatatcacaattatgagccataatttttatatccatctgccactgatattttattttcagtattctacctttaatcatgaaccttactttttgtatgcacttctgattatttccatggaacacattcactgagttataattgttgggtcacagggaactgctctgtcatttgaaatctgggaagcaggaaccatattgtaatgcgcctcatttataaacaggaccaccatgccatctgcagatggcactatgtgagcacctgactaaggtgggccaggtgctcttcatggtttttaactttgaggctaaaaagctggttttatgggccttcctaatcatattcatcttttagtacttgaccccttcctctggcttcttaagaagttaatgaatttaaaaatcaatactaaaaatgtttaaggtcataaatatcttctacttgctttacaaaggaagaaaaaacaccctggcctcacgaagcctttagtcctgcttaaattcattcacactttgtaggattatttcatattcttgaggtgggatattgaattattaatttagcaatttgtgttttcaggtcatgaattatgttaatttccatttcagtgaatgttagagtatttgaccagattgtgatgttgcctactttgtataaaatattcttttccatgaatacattgagaaattaattagaacatagattgtttggctcaacaaatcagaattaagtgaagggtaaaaaaatgggtttttatttctagattacagaataaatacctatatttaccttactttcctcctgaaaacatactaagttggctattaaaaatatacaaatgcgtaagaaaaaataggtagtgataccacggtagtccactcattttcttctctaaaatcagcacactcatccgaaactgtcacagatacctgctgctcattggctcatagccatgtctatcacaaggaagcagattctcaaataagattgtggctataaatcaatgaacagcagtctggcaataagaattctgtgaccagtggtgaatggggaatagatggcccatgacatgcaataataacacaattgttaaaactttcatcatcagttagtcaggatgggtaatggtggaaaggaagtacatgagtttatgcaatatttttcttgaaaagtatgagggaatatattattgaattgggtggctgtgactaagtgccataaattcaatgaagagagccaatgacaggcccagaatgattaatcagcaattaagggcaaaatctgaaagccaaaggagttccttggcagcatttagtaaaactctaatctcctataaatggagagaagacagaaaggaggaatgagctcacgactaaatcataagagtagaggagattcagacaatgttaaaggctgcaatttttacaacaaggtcagatatttgaaaggactcacaagattccatggagcacattcatgtaagacttttaatacaggcaaatgatacagtgcgttaggagaaagagaatgtaaaaaagcatcaatatctgaaagtcttccaggcatagctacctagggcccttattcacagaagggtgtgctttgtctttggactgaacctccaaggtttattgcaagtaaatttggtttggaaagaccttcgtaagagtttccagcagagttctgtattcccctaaattcacctagctaaatttggctgcagaaccagtgatgctacatataaggtatcaataaacaacccagcctgggtaccacttgcggtattctaaattttaaactaaatgttataaattatgagttagcccactacccttatatggcaatgagtcagatacttccatgtgcctctggagataagcacagaacggtcatagttcatctgtaaaattattctatgctacaaaatacgtagctccagtgagtttcctaggccaaattcagatttctaacaagaaagaaatgagacactgacacttggaggtgaaaatctgggtagattcatttgaaaccctggaactccagatgcccctagttcaactggtctggcagtggcctacttcttcttagaaaatagtagccacctccagcctaaagatcatggagaggtcttcatgaagcagatgccttatgagacaaagtcccttttcctggagtcaaccctcttcttccttcctgacaaccagatcaataataagagtcaaataccagcacagcccaactggggaataagactggcagaggtaggatagtatcactctcgggaacaatatcccaaggaagatatatttaaaggaggaatgcagaacataaagttgagaaaatgagagtctgtcattatgggagccctctgctagcatacatgatttagccctctgacagtccaggagatggtgctaacacactatttagatggctcatggaagcttgaaataagttacagcctatacagttagtcaaataaaaatgccaaaattgataggaaaggtataattgaaagggatcagaaggctcaagtaggcactctgataaaccatacaaggctggaaaacccaccagccatctgtttcttacaagacatgaaagacactccatttaccaaagaagagtgtcctaatgaaaggggtactaacattgttcagaagacagtgatggctgtcttctgcaggctaaagctgacaaaaagaggtgctacaacagaactgaattgcaaaaaaacaatggagattgcaggacaatggaatgataaaggtccaacacttaaccatcagtggcaagactaacgcaatcttcacaacagcagaaaaacctgaatggcaggcccatcagagggccatggagatggttaataggacagagtgttcctacaggcaagagggaggaaaaccaatgagtgttttaaatttaaagaatcagaagaaatcccaaatggataaacaagagggtgtggacactcaccacaataaacgtcatgatcccaccccaatttcctaaactagctctcagacctgaaacccaaccactgaagaaacagtttcgttcctataaagaaggaccctgaaatgccaaagcaagtgtattcagtagtaaactacctagtccatccccaaaggaatacacagccattttctttggtaacagtgaactggaaaaggggaaataactaggttttttttttttttttttttttttgaggatgcttggacacaggatctgagttggcacagatattcagggttccaaagtgataatatgcagaatgtggggactagaaaacaaatggagtcttcacctagatccaggtaccagtgaagctactaggtccattattccacctgatgaacacttctctagcattctaatgtataattagcataaacacacatggcagttgatgggaccttcatctaaagttcttgacctataagacagaggtagtttcagttttcaaattcagttttcaattgaagactgaaactacctctgtcttgagccaagagattaaaaaacaaacaaacaaagcaaaacaaagtagagtacatgccagagggaacggcagagattactgtcaccctcagtaactaaaaaaatgcaggggtggccactataatatcccacctaatttatcagtctgaccctgaaaaatataaatattttttaaaaagggatcattctttcttttaaaaatatctacaaaaacctataacttctagctatggacactgatggccatcctccccattctggtatttaggggctttctgcctgagggcagtttcccatccactggccacaaaatgaaatctaacactttacagcacccatacatagaggttctatttaggcttcccactccctgcaggtgtctattgaggaaataggtccagctatgaaataacacagataaaccaagtcaggtcctcttaattgtcaaaaaagttcttcattcttaaatattacagaaaaaaaacattctcaccagtcatagaagaaatccaactgcaagaagaagaccaatataaataaataatgctaactagccctaaagaaaaaaataaagattcatgaaacatataaaatatataaaataatcttaccagtatcttcagaaagtttggagaaaatattgaattcccaggatgctgtgaaaacagtcattagagaatgtgttagacagagaatgctgtagataattatgaccttcttttttgtttttttgtttttgagatggagtctcactctgtcaccaaggccacagtgcagtggtgcaatcttggctcactgcaacgtctgccttttgggttcaagcaaatctcctgcctcccgagtagctgggattccaggcacgtgccaccatgcccagctaatttttgcatttttagtagagacagggttttgccatgttggccaggctggtctccaactcctgacctcaggtgatccactgcctcggcctcccaaagtgctaggattacagatgtgagccaccacgcctggctgataattgactttcagtgtctatcttccatatctttagtaacaaaaacttgatttttagattaacacgcttcttcacagctaaactattatgcttctcagcattccacgaaactaatgggaaattatgttactaaattctgaccagtgagattgtattagtctgttttcacactgcttataaaggtatacctgagactgagcaatttataaaggaaagaggtttaatgaagaactcacagttccacatggctggggaagcctcacaatcatggcggaaagtaaggaggagcaagtcatatcttacgtagatggcagcaggcaaagagagagcttgtgcagagaaactcccatttttaaaaccatcagatcttgtgggactcattcaccatcacaagaacagcacaggaaagacccacccccatgattcaatcatctcccaccgagtccctctcataacacgtgggaattatgggagctacaagatgaaatttgagtgaggacacagagccaagccaaatcactctacatctggcccctcccaaatatcatatcatcacatttcaaaaccaatcatgccttcccaacagtcccccaatgtcttaactcatttcagtattaactgaaaaatgcatagtccaaagtctcatcttagacaaggcaagtcccttgtgcctatgagcctgtaaaatcaaaagcaagttagttacttcctagatacaatggaattacaggcactggatacatacagccattctgaatgggagacattggccaaaacaaaggggctacaggccccatgtaagtttgatatccagcagggcaataaaatcttaaagttccagaatcatctcctttgacaccaagtctcacatccaggtcacactgatgcaagaggtaggttcccatgttcttgggcagctccacccctgtggatttgcagggtacagccttcctcctggctgctttcacagatgggcattgagtgccctgggcatccagctgtatccatacatcccctgaaatctaggcagaggtttccaaaccccaattcttgatttctgtgcactagcgggctcaacaccatgtggaagctgccaaggtttggggcttgcaccttttgaagccatagcccaagctccacattggcccctttcagccacggctggaacaactgggactcagggtgccaagtcccttggctgcacacagcatggggaccctgggctcgacccacaaaaccacattttcctcttaggcctctgggcctgtgatggaagaggctgtcatgaagacctctgacattccctggagatatttttaccattgtcttaggaattaacattcggctacttgttacttacgcaaatttctgcagctggcttgaatttctcctcagaaaatgggatttttcttttctctctcattgtcaggaggcaaatttttggaatttttatgctctgcttcccttataaaactgaatgcctttaacagcacccaagtcacctcttgaatgctttgctgcagaatttcttctgccagataccctaaatcatctctctcaagttcaaagttccacaaatctctagggcaggggcaaaatgccatcaatctctttgctaaaacataacaagagtcacctgtgctccagttcccaacaagttcctcatctcactctgagaccacctctgcctggaacttattgtccatatcactatcaggcttttggtcaaaaccattctacaagtctctaggaagttccaaacttacccacattttcctgtcttcttctgagccctccaaactgttccaacccttgactgttacccagttccaaagtcaattccacattttcaggtatcttttcagcagtgccccattatgacaagaacagcacaggaaagacctgcccccatgattcaatcatctcccaccaggtccctaccacagcacgtgggaattatgggagctacaagatgagatttgagtggggacacagagccaaaccatatcagagatgtaactaaaactttcatatagaactttccaaaagtctcttaaataaaaagtaaaataagtcttatttcctctcctattcattttggtgtgaatacagtcatcatgtctgaaactcatgtaggcatcctgaaccatgaggcctgcattaaaaatggcaagttgtaagacagagtttgactccctaatgaccgcagaccagcaagcgtcctcagatttaggtatgtgtaaaaaaaagaaacttgtcctgtatacaatatatctggtaataattttactttcaatggcaaaatatgcaattatttttgcaccaacctaatagtaaacataagccaatataattctttttatttttttaagagacagagtctgtcatccaggctggagtgcagtggtgcaatcatagctttctacagccttaaacttctggcctcaagtgatcttctttcctcggcctctcatgtagctgagactacaggtgctccaccacacctggctgtatttttttttttttttttttttttatagagatgagatcttgctatgttgcccaggctggtatcaaattctggtctcaagcaatcctcctgcctcagggtctcataatttataaaagaaattaataacccttttggaaattaaaaacataaatagaaaaacaaaaaaaattggatgaggagggttagaacataaaggaggaaattgtctgtgatgtaaagcacagtcaacaaaagggacagatcatctcagaaaagaaatgtcaaagaaaaaaatccaggagtgctaacatttggataagagaaaaatattaagaagaaattattttggagaataagaaaaaattatcaggcctgactttgtattggaaggttgatcctataaattctaagctgaatattggtaagaagacaccaagaaattttagaacctaaaattttttaggcctccaagcctctagatggaagaactcacttgcagactcaaggcgccagctgccattaaccttgtcatcagcaacaccaaaccattcccttacaacttcagagttctaagggaaattaattttatttgagcatctgatactctatcaaaatctcagtggaatgtggaagcaaaataaatgcattttaaaacacacaggaatcataaaatttaacttcccattataaataacttagtttacagaatactctagcaaaatgacagagaaaacaaaaaaaattttttaaagacattgtattaatgaaagagggatacagtgatggaaagttccagcatggcagtcatagagtataaggggaggactcttgttttcccatggtttggaagtaggggttccaaggaagtaaaataaatgtatgtcaaaggaagctacaggaaatgacatttgtcacactaagagatggtgtaatccaaaggcataagaaagacacaagtagaaactacaggagtgccaaaagccatataagaaaatcatggtacaaatagaaagctaattaaaacatgatataattgtaagaatgataatttgaaggaattaagagaattattttgagcttgatgtaggcaacacggcagttatggcatcagactttaaataaagaaaatataatcccaacccattaattatgtgtctatagttcctgactcataactcccatagcccttgttctttctccccagggcaggccatagaaactgaaaatataacctcacattcacctacctgtctgtcttggagctggccacaaagcaatgctctgacctactttatctgaccgtaggtcataagacccacatttcagaaagggtcctgtaccatatactggaggaaggaatgccacatggagaggacaggaaggatctaaacagacaggccttgctggggttccccccacccaccccagtctattagtgttagatcctatcctttttgcctaatcacatttctacatggttgcccacgcttcaatcccacctatttaatgaagtctccacaaaaggctatttattttctcactgctgataaagacaaaccagagactgggcaatttacaaaagaaagaggtttaatggagaactcacagttccacatggctggggaagcctcacaatcatggcagaaggcaaggaggagcaagccatatcttacctggatggcagcaggcaaagatagagcttgaacaggaagactcctgtttttaaaaaaccctcagatctcgtgagattcattcactatcaccagaacagcgcaggaaagacccacccccataattcaatcacctcccaccaggttcctcccacaacatgtgggaattgtggcagttacaattcaagatgagatttgggtgaggacacagccaaagcatatcaacgggtatgaagagcttccagatagctgaacacatggaggtttctggagagtggtatactcagagagggcacagaaactccactcctcttctcccatacctcactctaggcacctcttcatctgtatcattggtaatatcctttatcataaatgtggttccctgagttctgtgagctgctctagcaaattaatcatacccaaggaggggatcatgggaaccccaatttatagctggttggtcagaagcacgagtcacaacctaggacttacaactggcatagaaaatgggggcactcttgtgggactgagccctcaccctgtgggatctgactctctctccaggtagacagtgtcagaattgagttggaggacacccagctggtggctgctgtagagatgatggcttgcctgcttattggtggggagaagtcctcacacatttggtcacagaggtcttctgtgttgattgctatggggcgagagcagagaaaaaacagtttgtgtgtatttccactcactcaacttgtatctgaagagaggaacatttacatcggcatagtcatttaaacgctatcttactggtttttcactttaaaaattaacctgtagataaggcatgaagacagttataaggaataactgatataatctaggaggtattttgcaggaagagaggaacccaggcaggctgtggctagaatagggaaatatggagataggatctaaataaactgaaataaaaatgtagaggttttaatatattttcaaaaattactacaataaaggaaggtaaaataataacataactatctaatgtgttcacctgcagggaacagaagcgaaagtacagtggtatgaaatgagatatagccttcttttctctatcagggaatcagatgtttttgaaagtacgtgagcgtcaaatgatcacataaactcattcttgggatttttaaataattgcataaaattcttgaaataacttgtaactgcttgtgtttaaaatattttcatgacatcaacaaatttgagcaaacattctgagtaaagataattaattgtacttgaaatgtcagactgagacccagggtcaaatttgcaaaatttttttaaaaagtaattattctctagtgccataaaatatttagttttaatattgctaaaatctatgttatgtctattacgttaacaactatgatgataactgggattttcctagtgaggaactaaaagtcctttaggtgttccttaattcataactatatatatttttaaatgcccgtttgggatcagagagattaaaagatgctccaacatgtttatatgagactgtgcataggtagctggaatctattcaaagtagttgagtgtttctttgagattatattctagctctttcccttcccaactgtgtgaccttgggcaaccacttaatcttccttcatctcaatttgatcccctttaaaatgagaataatatcagttcttacctgacagtgattatgacagtataagaaatgaattaacataaaattattcaagaattcttgacacataataagcattcaatagatgttagttatgatcaccatcctaaagaaagaaggaatgaggcttcatgagtctagcctaagaacacagtagacatatggagggcagtagttctgagtcttggctactactttaaccagcaggaaaactagtcctctggatggatgcaagtgtgtttcaaagaggtagataggtagaggtacaggtagaagtggagagagagggagggagagaaagagaaataattttaaaattaagatttttttaaaattcttaaaacaatgggatacaaataatattggtttgtatcatagacaaaaagaaaaaagtagttctccatccctgccgacccatttcaattttactttgcaccgttatacaaattggcacaaggaagccccagataatggcaatgaactgctgtggtcattaccgcaagacaagagagattctaatgcctgacagcgcagtttgaaatggctgtgacgcccagcaagtgggactgccttgtgtagcacaataatgagagcaccagaggctagacggctgctttgtctttctcaatccattcgttggtccctggctattctaaaacaaatacactcttttcatcgagaccctctgtggcaactgatgctccaaaatataatcactgcttcagaaactaaatgtttgaatttctcctaaattgacagttttccaagtccccaaattggttcaggagacatacagggagaaaatgttgttttatttcatctgggtttactgaattccctctttaacatgagttaaaatctatagtatccaatgtaacctatgttctaatatcagataagtccccaaaaaaatctacactacaggaagaaaaaattttctaaaatatttctatttctctaaatgacatttctttagatttaattttatagataatggttctaaatacttaagaactgttagaaacttcagcttgctgctatgttactttaatccaaatacactttccttcaaggcagaagtttaaatggaatgtaacggtaagctcaaatgcattttctttatcaagaaaactaagaataaagtagcttggatttgggttactttccagactagagagtctgtatttatgtaaaatgccagcatttaaaaataaaatcccaaatgtcccttttcaattaaatcctaactaaaatgcaaattacctaaacattgggactacaaaatgttctcatcttacctgccttcagaatttcaatataagtgtttcttgcattcaaaaaccactgggaggtgtttattgaatacttcaaaaacatttttcttaataatataaaggaaataataggtttaagatatttcaaagccaacaactttagtccatttcttcctacgccaaaccccttctgattgtatttttagcaaattttctatttaatctctttctatataacacagataaattttatcataaaatatatttttaggtaataaactttgaaaaaaatttcaacaatatctctaagcaaggacccagatttcttgattagatataaaccagcattttgttaatatttgggataaattctttaggctaaaagtgatcatttctcttttaagttttttcaccacattaccaagtcagccatgcataactagaatagtgctattacagggaaaattagatttaaatagaacaggattcccttctaattcatgtgtaatctttggagagtttaagaattggtaacattctgtttgtgcaatcttttgggaaaggttcctgccctacttaagtttcaacagattgtagtcatgcagaaacaagctttgactcccctgtctctgggcaaccaaagagctgaccatctggactcctggtttgataaagacttttagggagccagaaaaaatcctggcagcaaaagaacatacctcaaatggaactcagaaaaatcctcaaagacatgttacattccaacattgttttataaacaacttggtctttttatatgcacacacactctcacacacacacacacacaacgtacaaaacttaaatttaaatttaaaattccaataggacgttttgaattcaatacttaaggatgatgatttgtgtgaccatataatttattgatctaatcaggataattttttaagtatgaaaggaataactattaattaggacactaggaataacataagccagaacaatctctgacaaatcagatggtgcagtcaccctaactataatgaaaggagaattgagagatgttctcctggctaaataaatccatgaaataaaattcatggctgacaaatgaatttagtcatagctgcatttttatgatgttacctctaaaaataacattccaatgttcagcctagctatgatccaaaaaaattatctatcataaatgttggccaattgtccaattctgaaaatggcctcaagagaaaatcatttgccaacagattatttggacactgccttctgtggtagaaccaaattcttgacaaatgaatgatcacaactataatttctattgcgtgaactccatatatcaaaaagggaagtattacctctacagaattgaaaactgatttaaactcgatattttaaaagaacaattattcttgagcaattcttcaaaagtattgagttattaatttggaatttggtctgacttctataaaagacttgaataaatacaaaagtgacttttcagtattccactaaaaaaatttcctacaaagaggaagctgaaatcgttcaggaagggaatggaatgaggtctttactttgtgaagaagtggaagtgtcctgaccaagaaagggaatgaatcctcagagactgaaggagaggaaagtgacagaatccaagggttcttgaactcaattgccctcttgctggccatgatcagaaaggagagcacagcaatgctgactgagatcggaggaatcattgccacagtgttacaacccttggaaaattcccagtggtcaagttaacatgaaggaattggaaatcatttctttccctgcacgaatagaaggtctaggctgagggaatcttgtgctcagccatccatccatcttctaaatctacagtttactccaatcattgctagcagcaaaagagcactttactttggacacattgggtatctcctgctattttctcatctgtgctgggacacgaagccttttggcactcattaatgtataaatctaaaagtttgagagttaagaaatgatggggcaacatttgagaaatagaagacggaagtcagtggataaagaattcatctttcatatctcaagttgataattctaatgcaaactttaaataactcctcagaaatccaattgggggtggtggctcatgcctgtaatcccatcactttgggaggccaaggtggtcagatcacttgaggtcaggagtttgagaccagcctggccaacatggtaaaaccctgtctctactaaaaatacaaaaattagctgggtgtggtggaatgtacctataatctcagctacttgggagactgaggcaggagaatcacttgaacctgggaggcagaggttgcagtgagacaaggtcaagccactgcactccagcctaggtgacagagtgagactctatctcaaaaaaaaaaaaaaaagaaaaagaaaagaaaaagaaattcaagactgaaattcacttatacgcaagagagaacaaatcaaaatgtacctggaattttaccctccttctctactgcacccttcccaggacccaacactttttctctggtataacttatccttcctcctgcctctccgtgaaagaaaatctgtatgcaaaaatttgaatgacagttgagttctcatcagaaaccaccgagacaagaaaaaagtagtatgacatttttcaagtgctgaaagaaaaggcgtgcaaacccagaattctatatccagcaaaatcatctttcagtgatgaaggggaaatcaagacattctcaattgtgggaaatctaacagaattttttgccagcagaccaaccctaaatgaatggctaagctattttttgaaatagaaaacaaatgataaaggaaacaatctttgaaaaccaaaaataaaaaaaataatagaaagagtaaaagtatagttaatacaatagattttccttttcctgttgagtttttaacatatgtttgagggttgaaacaaaaattataacacttcctggtgtgggtgggtgtcaatgaggtgtaagaaatatttaagacatttatactaaaaatggagggtaaaaggattttgtaaaaggaggtaagattttcatactttactcaaactggtacagccactctgggacataatttggccgtttcttaaaacactaaacatacataacgtattacacagcaatcacactcctgagtatttattctagcgaaatgaaaatttatgcccacataaaaacttttataccagtgttcatggcagctttagttgtaatagccacaaatggaaccatcaagaatgtcctacaataggtgaatggttaaacatactgtagtaccttcataccctggaatactacacagcagttaaaaaaaatgaagtattgatatgtgcaacaaatgggatggctatcaagggcattttgctgagtggagggaaaaagcaaacctcaaaagatcatatacaatatgattcaataatattttcaaaataataaagttttagagagggaaaataaattaatagttgctaggggattaaggatggtgataggaaggaagaaggggaaaagtgtaactatggggaggttgcacgggggctatttttgtgatgaaatcattgtgtatcttcattgaggtggctattacataaatctacgtatgataaaatggaataaaactaggtacacacattataccaacatcaatctcctgggttttctattgtactgtagttacttaagatgtaaccattgggcaaaacgggttgaagaggggaaggcctctctgtacatccttacaacttcttgtaaatctttatttcaaaataaaaatttaaatagaaaaatcagaaagagggctcactgtggcaacttcttgttaaactttctgtgtagcaactcataagtgctcacttttccttttgtcagctgttgacttctttgttcgtgagtcagtatctttcataatgacctatttctctctggagtatttctttacacaatttatattctttttgatgcttagtgcctatatctgcaataaaaatttttctttttttcaacttttgactctttttaggagatgaatattctgctcatttgtgtctttcaacataatctttttttcaatatgtgagttaatatagaaaagcctctgaaaccaattttcctaacaatactaggccacttgcttcttttcaaaattgcttcaataaaacctcaatttaaaaggtactttattttttcaataaatttgaatagcataacaaaaatattttaaaattatttttccaatatatccatatattctacatacatgtgaatcaataatatatgcagacacatatatgcacactcacgtgaattaatgtagcctgtagagaaaaatatagttcattaatactgaggaaatacaaagcaaaagttttatcaggataattatttcaaacaaaagtttatcttaattgaaaagtacactcaaatagcatgccagtattcgacacataatcaagctagttgttcagggaagaaaacaagataaattattagttataactctaacatgtcaaagtcttatttcaaagaaattgactctgcaattagttctatatttaacttcctgtcaaaaccaaaatcaaatcccagaaaaattaaatctctaaagcccccctaacctttctcatcattttttaaattgtcagaatatcactgaaaatgttacttttctttgggacaatcccaggtgcactaaatagaactccatacattaatcataatgacagcaacttcagttgacggtagggaagttctaatacagtcatctcaaaatactgttcactcttttacgtttttttttcttcaactgtctggtcagtagagataaatgatactaattttaaatatttggagtgatatattgtctctagggttgttttggaaatcttgatgcccctaaatattgatgcccttggaggtaatttgactactctgaaatgttattatactcaagaaaaataaaaccttgaaaatatatcttacctgaatgggtaaaaatctttcaacaatgagaatagagttaactaaattatgaaaacagatatattcatgaagaaaaaaatacagaagaatgggaaaccaaaaaccattcgaataaaaatatatgaagacagagtgcagcacaaaatctcatagaaaggaatttggctaatcatcactattaaaatggatatacctctatccaaaaggtggagtggactaaataaaggaaaattatatttatatatatattttaaatggtgctttgtagcagtaaaacaaatcagttctttctattataaacttcctgattcaaatcaaaagaaaatatagtaggctgcaatttaaatagcacaatattacctagaagtttaaacccacacaaagtttgccatgttcaaggcaaatattgggaagataaaaataagcagaaagctgttactacatttaaattgccagatacctagttacctgattaatgaagaaaacaaaaacacatataattgtagaatttgtgtaatttctctgacctttataccacccatatccatcaaattaatagtttttctctttatgttaagctgtgtaaacaaatccaagtccacttctctttcacatattttgcaggtaagtgtgagagttttaatttattcatatagaaaatactctaaagctcgaaatatatctataaggcattcaattttggttctacgtgcttagcctgatttgtcatttctaaaggaatgtttaacttgggaattttctggtttaagctacagacatgtttattcaggtttttgcttgtctgtttagggtattgtaaggctcctgggaagatttgtatatataaacttatttgctgtgcacttaggaaagatgaatgaactgagagatagatccctttggatcttgtcttttttcttcctctcctttctctcccttttgtctacccctctccctctctccacttccctctctctcactccctcttcctccaccttctttctttctcctgctccctccctccctctctttcctctccattttgaaataagaaggattcatggcaacctgcacaggatagaatgaaacagatctgagtcaagaggagaatctctgaggataatttcttcaaacaggtaaggaagaataagaataaacttctcttaagttcaccgttatcagcaaattgcacacatagattcttcaacatttccaggcagaggaggcctaccatggggggaagagcaggagagcagatgcctacccgcccccagtacaagcagagcaggagcctgttaaagtccaggttaggacagggaaactcagatcaactttccacattcttggatcccaagctctggacactaactctcaacaagaacattcagaagtcataaacactagtcattttccctgtaaatgtcctgcatctatcaaaatagaaagtgaataatacgataaaatatttgttattcgcaacacatgctgcacagtttaaaaatattattcaattttattcaaattatccccatggtacatagttttttcaaggagttttaaagaaatccatttgcattccagtttcttaacctctttcaaaagttcaaacctctttcaaaatgtgaactccccatcattgactctgtgacctccctcttctcgtattatcttcatttttctcactgctctccagtcacattgtcccgcatgttgcttctccaacatgctagacatgatcacaccttagcgtctatctataggctgctttctctgcttgaaactcccttccccaggaagcatctccatctgttcaaatgtcacatactcaataaagtttaagactctttttaaaaatataatttataaaaatataattatcctccctgacagcacagttttgaacccccaccttgctcttctctattttttcctatttctatttcatttaccattttattctatatgttacaattatcacatttattagatctgggttttttttataactttctgtcttattcagtttaatgtaagctctgtgagaaaagggtctttatatcttttactcactaattatctccactttccagaataattcatggtgcagagtaggcattatttaataaagatttgctgaaactatgagtgaatgaatgagtgactcgctcacttatagtaaatcttactcaaaatactggcatacatgttgagaaagaaaatgactctcaatcagaagcttatctattaaaatttaagttgttcaaattcactatttttaataaaactaaaggaaggacattagaaaaaaactttagaagccattccaaagagtgtaggaatataaagactttccaaattgttttagattgtgcatgagcaaaaaattttaagacaagaaagagcctagaaagagattctggaagatactggcagattgctcaacaaatccattacgtctctttttttgaggatgtagcatgacaatattttatccatcttcttttatagttaggtgtggccatgtgactaagtcccagccaatagaatgtgggagacactgataggcataacttccagacctagtcctttaaaaatccctcacttgtgcttttccatgctctgtctcatttcctggcttgatagcaatgtgcatgataactcaggaagccacatgttgaatactgtggcaccacaagatgaaacaagcctggatcctggaaccactgcttggagggggttgcctgccatcgtgaatacacattggactttatataaatacgaagtctacttctcttgttttaaattactgagaatttgtggttcatgtattatggtagctagtattaccttaagtaatagaagaatgttcccactgtgttaaatagaaaaaatattttcttccacagactaaaattgaagcatggttaaacatgcagaatctaggtggaagtctgggatctcagaagatacaaaagaagctttcccttgcactgcaagatcacatatggcaaaggcttcaataaatatctctaatgggcctactctcttccttataactcatctgacatttttgtgatacaagggagaacagttgaattgtttgaaaaacttgcctcagaaagggtgagacagaaagctcactggtgaattgaaaaggttttcattgtaccgttatgggactgtttttaaaagactctatgttccttgtaaaattcattcttgaatcagatttgatttttagcaaacaatttcttacctaatctcaacctccagactttaatattctaacaattacataagtccattgcattaaaaagttctcaatagttatttttttagttttgataagttttaacaagacaaaaagctgacaagtcttaaatttggtaaaaggagattttgaaaaggagactccaaaaataatgcatttaaaatctaatttatatggtgcctcagaagagtttcaaacaaatgaatagtcttctaagaagttataaattcatgtccgggatagaaatatctgtgaatcactaaattatttctctcatatttgctggtgtaaaactagggaatagccaagcagcttacattatcaactgcttatgaggatgctaaaatgatatacttaactgatatttccatctagaggcactgtataattttgtcaccaaaaataactatagactcaagaatataaggaggaatattttatatagtggcatacaaagttatgacatttatctgtcattttcccatattatttatcctcaaaagagtttgtttctttacatcatgtggaaggataattggtcccataaagaagtaattatttatatcaacgaggtaataataaaagagaatggctcataatctactggacgttgcatggcctgtgatgtctctttccttctagtcactttcgaaagctcaaataccaacacctttgtaacttcctccttttcccccatatacatagtcaattcttcttttgtactccctcaaatgttaatttgtacattgattttcacatttacattactgtattataattacctacttacgtttatgacctgtctgatcaattttaaattagcattttcttctcccttgtgtctcggtacattgtatgctgacatagagcagattctcaatggatgtttgttaaaggatgcattttatttcctcagtaaaaccattttatgtcattagacaaattcaagtatacagttagattccagaaactatagtctaccatataattaaaggtatttctgctattttatgtcattgaacaaattcaagtgtacaattagatttcaaaaattatactctcccatgtaattaaaggtatttctgaaaaaaaaatgcttattcatgaaggacagtgtttttataaaatttgatatctaatgactgatgtttaatagctgtggaataaaagaatgctaaaagtcatactgaatgcctgaaaaaatgagtcagtagttgggactagaaccaaccaaaagatccacagagtagaggtgataagaaggtgtcttgagattttagaatcaatagcaaaagctattagtatccatagccatggaattaagcaaaaacaacagacaggagaagaaaaatttattcagtgatgaaaagaacattgaaaccaaagggaaggaacaagtgactcatcacaaaagtgtaccactattaaaggtaagagaatagacctgctgtggagagaattagaaactggttgctaatgtgcctacatattgagaaaaacattctagttcctattttcctaaatttcaatcacatccttagaataaaattctattatctaagctgacctaagtttacttctgttcctcaaaacctgaaagaccctaacaaaatatactggtataacgaatgacttaattcaattgtgtcttttctacctacatccacaaacaagtaccaaacatcaatttttttttcaggaaaacaatcctcttatttttcattacattctactgcagttaggacaccacacaagttttacttcccctttcctctgacaatccacatcttgttgccacggtctgatcattctacttctgttacacatctcaaaatagtgtcatgatcttcattcctactagtttacatatttttcatactcacttaagtcttcctaattgatctcactacatttctttatttctatgtgtttttgtgatggtaaatatcaacctttcattgccacgtttaagtctccttcaagcatttcctgtagaaccagtctagtggtgactaatttccttagcattcacttgtctgggaaagactttatctttccttcatgtatgaaacttattctggtggaatatacaattcttgacttaaagttttgttttttcttttttatagttcaccactttgaaaaatgacacccaattttcttctggcctgtgaggtttctgctgaaaagtcagctgttcatctgatggggttgtaaaaagcagtataggtgactagatgttttcctcttgctaattttaaaattctttatttaactttgacgttagacattctgaatataatatgccatgatgtagtcctttttgcagtgtattttcgtggggatcattggatcttctggatctggatggctaactctgttgatagacttgggaagttgtcatcaattattttcttaaacagattttctatactttttgatacctcctcacccttgggagtactgatcattcataaatttgctcattttatgtagtcccagacatctcaaaggctttattcattctttttaattatttttgtcttattttaaaattattttaaaagacctgtcttcatgttttgagattctttcttttacttcatctaacctattattgaagctttcagatatattttatatttccttcaatgaattattttagtttcagaatctctgctttttttaaaaaagtatctttcttcttggtaaatttctcattcacattctgaattgagattctgatttctttagtttgttttcagatttttcttgaatctcactaagctttaaaatcagtattttgaatcttttatttggcatttcaaggaattctttttgattggggtctattgctagacaatctttgtggtcctttagtggtgtcatatttccctgcttcttcatgtttcctgtgtccttccattgatatctgcacatctggtgtaacattcgcttgttccaattttttgaaattgcttttgtaggagataatttttttttcctgaagatgtatgtatgctgtgggttaagatacttttgctttgattttgggtgtctgtggtagtgttatctttgtatgacttcttcagcagtacaaaggttcagtggtatctgtgatttccttggtagcttagggtacagttactagttgaggttttggtgaagttttgctggggacttggacaccagctaagccagtctttgggccctggtggtgacggcagtagggtgagtttgcctgtttttaggccccagagcaacttacactggctctgatgttagtcggttaaagagggctgattcttgggactctgggtggctttcttagaagctagtagtgggagcggtaggccagatgggtgtgtgggttctcagatgcctgggcaactggttcattgtgggtgatggcaggagcagcagtagagcagcccactgggatacaagtggcccatgttggtgttgctggaagctgaggtgtgttaagtgggctagtctgtagtcccacagtcatgagtagcaagagtggtgggtattgtcctaagtgtgcttcggagagtttgctcttccctttccctccccagttaggtggcagctgcagctctgttacctcaaactcggcctgagggtgaggcacagcccagtgttaaattttcaaaatggtgccagctgtgggctagaaaccagaaaggatggtgcccatctcaggcaagcagcacaggcaagaaactttggagaatatgatctgctcacatctccatctcaacagcagtccacaggagattgcaagggaccctccttgggtgcataggagcacccaatctcaacctcccttctccctttttgaagcctcacaaaagcagcagctgccatgtctggagatccctggtatccatccctcaaaatgatgcctagcggaggctgctagaacaaaggctcaaatacctgtgagattacatgtacattccctttgtggagcaatgtctctgaacaacctttagctacctccatatgtcaggcctaaagacctcatgggttgagggtttctcctgtagccaagactgtggaaccttgggggtttctccattactgtttccctgcctccaggagccattttcccgctctcagtcagtccctggccaggcaggctgccttgaacactcttctttcttactcttgggcttcctgtctcttctctagtgaatcctaggattctcttctagacaatctgtttaaaatgtgagtatccattaattattctggttcctctccacagaggaggtacatactacttgcatctagtcagccatcttgatccctctccctgcacttattctttctctgttctaatcctaaaatagctttaagaaaaaataattgataataaaagtggctgaatacaacatatacatatgtaaataagataggtctgtggaaaaggtctccaattcattacagaataaataaatctgaatggagtaaatcatgatgagtttatatatatgttcaagtccataaactaaggtttctgagaggaaagttgtggatgaaatggattctactgagacactgatatgaggtcaaaggaaacctgacactgaaaaatactgaaaggtagaacatcatcattgttaatatacatacttctaccagatttgttatgctgaataatagcaattttgttacctttaaattaaatttaaaattcaattttaaacagagcaatttaaaataatttaatcgaaggtcgcatggtggtgggcaattgggaattggggccagcagatgacaagtgtcgtctgagaagaccaaagctaaatgcttctgggtttttgagggcccataacatcgttcagtctttcctgtcagagaatagaaaccgctggctccatgagaatccactaggagaaacgtgggtggcaatggagagcaaggactcaggatcactctcagaccattctgctcagtgatccagaaatgtacaatatgccaggccttaaatatgttaaatatgttgtaatgaacaaaacaaatattcttattcccataaaatttaaaattttgtgaagggagggagaattaaaaatatgtcaagaaaaaataaattattcacaaactttgataagtgctacaagaagaataaagagggtgctgaaggagggcataatgggggcagccactctcatacaggcagctaggaaggacctttgaataagggtcctgaataatgagcagaagtcagccatgtgaaatgaagataattgtattttgggtggaggaaacaatcttttcctaaggctatgggggagaaacctgattccagtgagttgagaagttgaacaaggtgagcaatctgcccagaccttacataagaaggaatatggagaaataagtgggcagattggtatggttcattgtggtcatcatcatcattggttggaagggatagaaataatatttatagagtggagagaaggaaaccacagaaagacttgacccatggagggtttatgatttgattttgacaacatcagactcagagaaacctctcagtcctcagggactagatgagtgcattagcctctccctctctaggccagcttcaggtttccagctgtaccaaccttcttgggtttccatcattggctggatcaggggcttgtcctttgtcattctgtaccctgttgttctttgtcccctgtacacctcttatttactttaactataatattttctaattatttttctctgggaagttttcattagaatttgcctttcatttcccctattatatcaaatctgcattttaaagatttttatgctaatttattatttatcacatggattaagaatggaaaagatttaactcttgagtaagtgatggggaagaaatagaaaagaaagaagaaagtagagagaaagaaggtgagataaaagctaccagcccgaatatcacgaaaaatcaggtagtgtctacagtggctgagcactggtcatgtgtaaaaagcaagagtatgattctgagctgtgatatttggtgtaaatatagtttctattttatggaagaaaagtttttaaactacttctgtaaggacatttacctagcgtacctaaaagctaaatggatatcatgtttgatattttaaattttttttcttggtaaatacactagaatatgtccatgccatttaaaaaaataatgaaatctgagttgtaagaaaggaagtaagtgttgatggggatataagttgggaaactgtcaaaagccagctgatttaaaagaatgagagaccatatagtatatttcatcatcttcaagcagacttacaagtaaatccccaaagatataaaattcgattaccatgttagaggtgccagaggtagataatatgatccttattataaataagtttacactaacacataaaataaaaaagactgaacaaagcaataaatatagaaaaagtcatgccaatttaaccttctgggagcagttacaggagagactgctgaaatagaaaacagtagtagttacattttaatgattaaagaaatatgttttattttaaaagtcatttgttatattaatgtacagatatctttaaatttctttagaaatttcccagctcaagagaaaaatcttaaaggaatttaatataccgtaatttactttacaatgtcatcattcttttaagatcttttcatatataattgtgtaagaactcacttaggattctaagaagaatgcttacaatcagcacacaagttcttatgttctcttgacagtcctgggtgaaaatatttctgtaaccttagccaaaaaaaggcatgcatgcatgacacctccatggctctttgaaattggtatccttttgcacagtaccaaagtgtttctaattatagatttgagaatataagtattttaatttaaaaattgaagctgatgaggaggttccaagatggtcgaataggaacagctccagtctacagctcccagggtgagcagcgcagaagaggggtgatttctgcatttccaactgaggtaccaggttcatctcattgtggcttgtcggacagtgggtgcagcccactgaccgtgagccaaagcagagcagggcatcgcctcacccaggaagcgcaaggggttggggaattcccttttctagccaagggaagccatgaccaacagtacccggaaaatcaggacactcccaccctaatactgcacttttccaaaggtcttagcaaatgacacaccaggagattatattccgcgcctggctcggagggtcccatgcccatggagccttactcactgctagcacagcagtctgagatcaaactgcaaggcggcagcaaggctgggggagggacatccaccactgctgaggcttgagtaggtaaacaaagcggcctggaagctcaaactgggtggagcccaccgcagctcaaggaggcctgcctgcctctgcagccataaaaaaggatgagttcatgtcctttgtaggcacatggatgaagctggaaaccatcattctgagcaaactaccacaaagacagaaaaccaaacaccgcatgatttcactcataggtgggaattgaaaaatgagaacacatggacacaggaaggggaacatcacacaccatggcctgtcatggggtggagggctagggaagggatagcattaggagatatacctaatgtaaatgagagttaatgggtgcagcacaccaacatggcacatgtatacgtatgtaacaaacctgcacgttgtgcatatgtaccctagaacttaaagtataataaaaataaataaataaataaataaaaattgaagctgacagaaaaagaattttttttgaaaagaagatggaattaaaaacatttcctgtgtctttgaaagttgtatctcataaaatatctgcattgccatgatttatttttgtcaaaggcatttgaatacatatgattagaaataattcaaagattaatatttatcattttaagtgctaattttaaagctaattaatagtcttattaaagtctaaataatagtcacattttagaaacagaacagagacctcagaaataacaccacacatctacagccatctgattttcgacaaacctgacaaaaacaagcaatggggaaaagatttcctactcaataaatggtactgggaaaatggctagtcatatgcagaaaactgaaactggactccttccttacaccttatacaaaaattaactcaatatgaattaaaatcttaaatgtaaaatcaaaaaccataaaaactctagaagaacacctaggcaataccattcaggacataggcatgggcaaagacttcataacaaaaatgccaaaagcaattgcagcaaaagcaattgacaaatgggatctaattaaactaaagagcttctgcacagcacacacacacacacacacacacacacacatacatacacacatatacacacacacacaaactatcatcagagtaaacaggctaactacagaatgggagaaaatttttgctatctacctatctgacaaaggtctaatatccagaatccacgaggaacttaaacaaatttgcaagaagaaaaaacacatcaaaaagtgggcaaaggatataaacagacatttctcaaaagaagacatttatgtggccaaaaaacatgaaaaaaagctcaacttcactgattatgagagaaatgcaaatcaaaaccacagtgagaaaccatctcataccagtcagaatggtgatgattaaaaactcaagaaacaatagatgctggtgaggctatagagaaataggaacagttttacactgttggtgggaatgtaaattatttcaaccattgtgaaagacagtatggtgattcctcaaggatctagaaccagaaataccatttgacccagcaatcccattactgggtatatacccaaaggaatataaatcattctactataaagacacatgcacatgtatgtttattgcagcactatttacaatagcaaagacttggaaccaacccaaatgaccatcagtgatagactgggtaaataaaatgtggtacatatacaccatggaatactatgcagccataaaaaagaatgagatcatttcctttacaggggacatggatgaagctggaagccatcatcctcagcaaactaacacaggaatggaaatccagacaccacatgctctcgctcataagtgagagttgaacaatgagaacacatgaacacagggaggggaacaacacacactggggccttttgggggatggctgatgaggggaggaaacctagatgatgggtcaataggtgcagcaaaccaccctagcacacgtatacctatgtaacaaatctgcatgttctgcacatgtatcctggaacttaaagtaaaataagaaaaaacagtcacattttaagtgctaattaacagtctaattaaatgaatttctaaatcattcatttaataaggctattaattgtatacttgttttcatacttattgttatcgtcaattaaacaacaccatacttctgaatcaaaaatactgcaagcatttcccttaactttttctaaatgacatagaatttctttttgtttttttaccctattcctggaaagcaggataaatgacacagaatttcttgattaaccaggtcaataggcagcagaaaagctggagaagaggtcatgggtaaggtaaatagcaattaaaataaaatcagtgaaaatgtgacataaagtatatttagtaagatactttcaaccaggcacagtggcttacgcctttaatcccatgattttgggaggccaaggcaggtggctcacttcagcccaggagtttgagactagactgcgcaacatagtgacatctctacaaaacatgcaaaaattagccaggcatggtaagttgcacctgtggttccagctcctggggagacttagatggagggattgcttgagcccaagaggcataggttgcagttagccaaaatcacagcactgcactccagcctaggtgacagtgcaagaccctgtctcaaaaaaataaaaaatataaaaataaaaaacttcagataaaattatatctagtattgagattaaatgtaatactatgtattatgtttcttttgtgaggtaaactccttttcactgatacaacagtaatttttttgtcttgcaaagttctctaccaattttaaaaccccttgatagaagcaccatataaaagcaatttactaatattattttcattaaactattcaccagagatctatactattatttgaacagctataatcaaatagaagtttcaaacttatcaatgtgtaggtttagatgggacaccagagctaagatggcagataggaggcaagactagcttgcagatcccacttggatggacagagcagagtgtggagacccatatcatgaacttttgcttcaagaagtactgcaggaacataccaggaaaaccaagataatccatagaccctttgaaagaactggatcaccactgcaggctccttgagacatggaaaaactgtgtgtctgccagctttctcagtggggaggctcatggtctgaggaaagctctcagccatggccaccggttgcctggaaatagacttggttctgttgaaggggcatggtgggagtgagaacagcctttacgactgccagctgcatgagagaagggtgaggtctatgactgccggctttcccccacttccctggtgacctctatggctcagagagggcagccataatcaccctgagaatatacctccattggagtgggaccacacccccgtgccccacagcagctgcaacaacccccacctaatgagaggctgagctcagacacacctaatcctgcccccacctggtgatctttctttacccaccctggtagccaaagacaaaggtcataatctcttggaagctctatggccctgcccacctgagaaacttgaatacctaaccaggtgtccctaaggcaagtttgcatcctccctataggaccacagctgatgtactcttgaaagcactacctcctggctggaggccaaccaacacaaaaccagtgcactaaacaaaaacacaaccaagaaccctcacagagtccacttcactctcccgctacctccaccggagcagatgctagtatccatggctaggagacctgaagacagatcacatcacaggactcttttgcaaacactccccagtaccagtccggagcgtggtagctctgctggttggctagacctggaagagcaaaaataatcactacagttcctaaggcaaaggggagaacaccacacccagggagcaccccatggaacaaaagaatctgaacagcagcccttgaatccccttgaatcccagatcttccctctaacatagtctacccaaatgagaaggaaccagaaaaacaactctggtaatatgacaaaatgaggttctttaacaccccaaaagatcataccagttcacccgcaatggatccaaaccaagatgaaatctctgaattgccagaaaaagaattcagaaggtcaattatgaagctaatcaaggacgcaccaaagaaaggtgaagtccaacttaaagaaatcaaaaccctaatacaggatatgaaaggaaaattcttcagtgaaatagataacataaataaaaaaaatcacaacttctggaatcaaagacactcttagaaaaatgcaaaatgcactggaaggtctcaacaaaaatagaactgaataaacagaagaaagaacttcggagctcaaagacaaggcttttcaattaacccaatccatcaaagacaaagaaaaaaagaattgaaaaaatgaacaaagcctccaagaagttaggggctatgttaaatgtccaaacctaagaatgattggtattctcaaagaataagagaaataaaaaagtttggaaaacacttgagggaataatcgaggaaaacttctccagccttgctagagatctagacatccaaatacaagaagctcaaagaacacctgggaaattcattgcaaaaagatcatcgcctaggtacatagtcattagtttatctagagtcaagactaaggaaagaatcttaagacctgtgatgcaaaagtatttggtaacctataaaggaaaacctatcagattaacagcagatttctcagcagaaaccctgcaagccagaagggattggggtcctatttttaacctccttaaacaaaacaattattagccaagaattttgtatccagtaaaactaagcttcataaatgagggaaagatacagtcttttctagacaaacaaatgctgagagaatttgccactaccaagccagcactataagaactgctcaaaggagctctaactcttgaaacaaatccccaaaatataccgaaatagaacctccttaaagcataaattgtgtatgtttaaaggaaaagtttgcctgtttatttcagacattttaatgagtttcatgcaaattgaataaaaccatcattaccatataatagatatttaaaaaactgatttttcattttttactttattatgtgtaaaggacatacatgtaatgcaatatatgcttcttacagtcatacattgattaacaatgggaatatgttctgagaaatgcatcctttggcaatttggttgtgtgaacatcattgagtgtacttacacaaacttagataagacagcctactacgtacccaggctatatgtaggaaagcaattgtttattagtgaagtgcttttagcctattgcttctagactacaaacctgtacagcatgttactgaactcaatgctgtaggcagttttaacacaatgggaagtatttgtatatctaaacatatttaaactagaaaatgaacagtaaaaatatgatatgaaagataaaagtagtatacctgtacagggcacctaccataaatgaagcttgcaggactggaagttgttctgagtgagacagtgagtgagtggtgagtgaatgtgaaggcctaggacattactgtagactttataaacactctacacttaggctacactacatttaaaaaatacatgtttttcaataatagattactgtaaatgttttacttcatacacatatttttaactttttgactgttttgtaataacactcaaaaaacaaacacattatacagctgtacaaaaatactttccttctttatatcctcatcctataagcatttttctattttaaaaattcatttatcttttactttctaaactattttgttaaaaacacagacacaaacacacaagttagcctaggcctacacagggtcaggattatcattatcactgtcttccacctccacaccttgttcactataaggactttaggggaaataccacacacgaggctgtcatctcctctgataacgccttcttctggaatacctcctgaatgatctgcctggggctgttccacagtaaacttttaaaaatatatcagtagaaagagttcactctaaaataatggtaaaaagtatagtaaatacataagccagcaacacagtgtttattatcaagtattatgtactattcataatctcatgtgctatactttcatacaacttgtagcacagtaagtttatttatacaagcattaccatttacatgtgagtaatgcatcatagcaccacgttaaaatgtctatgacatcagcaagtaataggaattttcaagctccattataatattatggcatcatcattgtatatatatcattgatcaaaatttcaacatgcagtgtatcactgtataattaaatgtataatatataacaataaaatgtatatcattcatatgtacagatacttttttttaaagcttgaatattttgcccccttggcctgaatttatacattattgctagggatgtgcatttgggaaataagagtacatctctcagcctcaaatttcttattttctcataaataaaatgttataactatgaaaacaaaatatatctctccaatggataaaaacattaattgtaatatctctaatacttatactcttaatctatatagcatatagaaatattgatcagtttcccaataatgctgcatattgtgagatgttaattggtgatctaagaaaaaaaattcatcgtcaaatagatttggaaattattgaaagactgatccattcacaaaattgtgagtaatttgaataagtaacatatgggctatgatcctgtgagggaattatttcttaaagacaaataaaacttttacaactgaaaactactacacaaaatgaagtaaaatttaaaatgtattgaataggatcagtatcaaaatggagatatcagagtaaaacagaagagaaacaatagttttaaagaatgtgtacagaaccataagaccctgtgcatagcccagaaaaatctaaaatttgaataatttcagtctctgaaaaagagaagtatgagtgcagaaataatggcttaaaaattcttaaatttggtgaaggtatatgatgtggtttggatctgtgtctccattcaaatctcatcttgaattgaactcccataattcccacatgttatgggagggacctggtgggagataagtgaatcatgggggtggtttcctccatactattcttgtggtagtgaataagccttacgagttttgatggttttatcagggatttccacttttacatattcctcattctctctttgtctgctgccatccacataagatgtgatttgctcctccttgcctttggccatgattgtgaggcttccccagccacatggaactgtaagtccaattaaacctctttcttttataaattgcccagtctcaggtatgtatttatcagcagcatgaaattgaactaatatgtaaattggtaccagtagagtggggtgctgctgaaaagatacctgaaaatgtggaagcaactttggaactgggtaacaggcagaggttggaacaatttggagggcttagaaaactcgaaaatgtgcgtaagtttggaacttcctagacacttgttgaatgactttgcccaaaatgctgatagcaatatggacaataaaatccaggctgaggtggtcttagatggaaatgaggaacttattgggaactggagcaaaggtggctcatgttatgttttagcaaagagactggtaacatttttcccctgccctagagatttgtagaactttgaacttgacagacatgatttagggtatctggcagaagaaatttctaagcagcaaagcattcaagaggtgacttgggtgctgttaaaggcattcagttttataagagaagcagagcataaaagttcagaaaatttgcagcctgacaatacaatagaaaagaaaaacccatattctgaggagaaattcaagcaggctgcagaaatttgtctaagtaatgaggagctgaagtcaatccctaagacaatagggaaaatgtctccagggcatgtctgaggtcttcacgcagcccctcccatcacaggcccagaggcctaggagaaaatgtttttgtgggtgaggcccaggatccctgtgctgtgtgcagcctagggacttggtgccctgcgtcccagccactccagctgtggctgaaaggggctagtgtagagcttgggccttggcttcagatagtgcaagccccaagccttggtagcttccacatggcattaagcctgtgagtgcgcagaagtcaagaatttgggtttgggaacctctatctagatgatttcagatgtatggaaacacctagatacccaggcagaagtttgatgcaggggcagggctttcatggagaacttctgataggggagtgcggaagggaaatgtggggtcgaagcccccacacagagtccctgctggggcatctcctagtggagctgtgagaatagggccactgtcctccagaccccagaatggtagatccacctacagcttgcaccacgcacctggaagagctgcagacactcaatggaagcctgtgaaagtagccaggagagaggctgaatatactctgcaaagccacaggggtggaactgcccaagaccatgggaatccacctcttgcatcaacatgactgggatgtgagacacggagtcaaaggagatcattttggagctttaagattgactgcctctctggattttggaatttcatgggccctgtagcccctttgttttggccaatgtctcccatttggaagagctgtatttacccaatgtctgtacccccattatatctaggaaataattagcttgcttttgattttacatgctcataggcagaagggacttgctttgtctcagatgaaactttggactgtggacttctgagttaatgctgaaatgagctaagactttggggaactgttgggaaggcatgattggtttagaaatgtgaggacatgacatttggcagtggccaggggcagaatgatatggtttggttctgtgtccccacccaaatctcatcttgagttgtactcacataattcccacgtgttgtgtgagggacctggtggtggataattgaatcatgggggcggtttcctccatactgttcttgtggcactgaataagtctcaaaagatttgatggtttcatcaggggtttctgtttttgtgtcttcctcattgtctctttgcctgctgccatccatgtaggacattagttgcttctgcttgcctttgcccatgattgtgaggcttccccagccacacagaactgtaagtccaaataaacctccttttttataaattgcccagtctcaggtatgtcttatcagcagcaggaaaacagactaatacagtatacttacagatttaagaagttcagtaaaactcaaatgggataaatgcacaaaaaatccatacccagatgcatcacaatcaaatggccaaaaactaaaaacaaagaaaaaacacttgaaagcaactcttgaaaatattacgttacatattgaggatcaagaattcacatgttttgggatttattggaaaagatagaggtaagagaacagtagaaaatatttctaaagagctgaaagtaaagaactcttgacccagaattctaaatccagtgaaaatatttttcaggaataaaggaaaaaaataaaacattctcaaatgaaaggaaactaagagaatttgtcacccattatatctcattaaaaatctatataaaaaggaaacaaataataaaatggtagacagaaatacaaacatatcaataattacattagctgtgcatagtctaaaaattaaaatacagaaattgtcaagttgaattaaattttttaaagactcaattttgtgccagttacaagaaatctattataaatataatcagataaataaattaaaagtaaaaagatgaaaaatgacataccatttaatcattaaccaaaagaaaacgtagtagctatattaatatcaaatgaagttaatttcagagcatgaaaaattgtccagattaaaaatattaaaagggctaattcactgacaataaacaaactattctaaatgtgtcttcacataacaatgagcctccaaagtacatgaagaaaacctgctagaactgaaaggaaataaaaaagacgtatctacaattatagttaaagactttagcattcctctcttagtaactgatataaaagaaaatcagcaaggatataaaaaattcttaaactggacttcagtaaaataaaagcattttgctcttcaaaagacattgttaagagaatgcaaagagcagctatagactgattagcgacaattgcaaatcacatacttaacaaaaggcttgcatccagaatataaaaataaatttcaaaactcagcaataaaaaagcaaacaacccaatgtcttttaatgggaaaaagattgaacaaatacttcacaaaaatgtcaagtaagtacacgcaaagatgctcaatattctttgtcacaatgattaaccatagtaacagttgctacaggttcttacacatgaaatcatgttcagttggctaaatgtttaaatactaaaataaaatacctaaataccagaaatggctcaatggcttgcaatcaaattttcacaattttcctttcattttatgttgtaaaaaggtagaaataatataaatattttagagtcaaagttttaaaataaaaatatgtggaatattatatcattgtgctttctcctatttttatatatgttagctgtttatatattaccatctcctgaaacagagtagcaaataaagtgtaagttgcattttcctctattttattgactaaagaaagtatgcttttataataaagggtatatgaaatccaaaggctgaaacttctaatagtttccaagtgtttttcatttttttttctatttagatatacagttcatttttattagtggaaattcattctcaaagttgaacttggtttaggtcttggcaaatcatttttcaattctaacacccagtgttgtgatattatgcagaaaaagatactctcatacatttctaggtggagtgtatattagtttaaaaaattctagcaggtaatcttcaatattcaaaataatctgaaaataaaagaatcaccttttctttagtatataacattttattaattattaactaatattgactgcatcctaggcactttgcaaatacatgatattcattatttttatgaatcgtcttaaaaactttgtatagtaggtaatattttgttatatctatcttatctatgagaaaattgaggcttgcagaatcttgtacaaggtcatacaattagcataaatagagccatgagtagctaattatagagagtaaattagcattgtacctctctaagagtaaatgcttattaaattgtctctttaaaaaaattttcaagtgactatgtttataatcacctctttaaaattactactaaaatcctatttatatggataaaattgaggaaaatgcttggaggtatctcttgacagcattatggtgagagccaatgtcccaaaaggatcatatttaatacaaatctgttgattggcctcagaagatctatgatgaatacagaagcagtccaggggcaaggaagaaaggaagccttaattagaaggaagagaatcaaattcctgagctctggccaagaacagagattggctaatactatgtgttatgtaatgtaataccaagtattaatacaatggttacaagatcatttgaccctttgttaaaattgaagaaattagttatgtatcttccttttacgcatacatttattttttattttgtccttctactcatctactcattttttctttttgtttttttttctttcagatggagtctcactgtgttgcccaggctggagtgtagtggagcaatcttagctcactgcaacctacccctctgaggttcaagtggtcctcccacctcaacctcccgagtagctgggattacaggtgcaggccaccatgcctagccaacttttatatttttagtagagacagggtttcaccatgttggccaggctggtctcaaactcctgacctcaagtgatccactcacctcagcctcccaaagtgctgggattacaggcatgagccacagtgccctgcctattttttctaaattaaaaatacatactgaaaccatatgtgtttgctgaaaagctattcgttttattaacttaacacctatactgccttattttctaggttttcaatgtataggtcatcataatccctaaattttgccttcatataacaggagatacagagaaaacatccaaatctactcataattattttaatgcattcatctcattctgtatctttactattacaaagagtgtaatggaagaagaactagctggctaatatctaattaaagtggcataaacagtaactttagaatcacctctgctttgttgcactgctgctcaccaggtacctttggtgacttctcatccatagaccataggtcattgatttgtaataactatcattaatttaaaagaccggagcttcgtttcttaatttcttttagaatgaatgtcctgatgttaattgccttactgctttgcactaggttaaattttctttcctttcaaaagatggcaaaagtaaagtttcaccatagcaaaaaagttatctttagccgaaataactggcatgatctgttaaatatgttttaaacctatcttgttattgctggttagtttgtcattaatcattaagtttatagaatatatcaacaaaatatgaaaaaaactccttcttttaagagtgtgtgacatagaaatatgtcttcagggatttccttctatgtaatttttcaattcctttgccactaggaaaatgatgtatctcactatgagttttaagagttgtcaaatataaacatttaaatggatttaaagtaaatgtatgggaaaagcatataatatgaaaaataagttggagtggcaattttcatgagataaagcagacttcaagacaagattattaccagagataaaaaggagcatgttataatcatagaggtacccaacaacaaggtttaaaatacatgaaaaaataggaaattgagacaattccacaattgtagtagtatgttttaattctgttatctcagaaacctgtacaaaatgagcaaagtcttacatgattggaaaagtctgattttgtctaataaaaatttttagcatctttattgagacataattcacatgccatagatttcattcttttaaagtgtacaattcaatagtttttagcgtatccagttttgcagccatcaccgaaatttaaatttagaaatatattaataacattaaaaagaaaccctattatatgtttattccctaatcccctcagtctcaggcaatcataaatctttctgtctctaaagctttgcctattctggacatttcatataaatggaagaattataatacataaaataacgtatttccgtttcctctatgttgtagcctgtatttgtatttcatttctatttattgctaaataaaatcaccccccaaaaaacctacagttaactttatttttaaaggtgaaacactaggtcctgccaccagccccacccatgcatgaacaatgcccatacattccccttgtaacaggcccactgatctgaaatccaactatgaactctgaagcagacctgtaactcagctccatttctgctctagcataaactgggagcagtcttgctcacttaattaaggggcccagtaagggacatacctttccatgcctccagtagcaggcctgtccacctaagaccagattgcagatactgaagcagctctgtgattaaattccagcaccactctactgcagtctgggggacattccatcaacccaaaaacccagcaagagaaggcctttaccttctgaaaacagtctgtaaagactggaagaggcatttacccctccagatgcatacacacatggatcatgaagaaacaggcaaacatgacaccaccaaaggaaatgaccctttaaaaaaatgtagattcattaactgctcgacaaagaattttaagtaagcatcttaaagaagctcaattagctacaagagaacaaaaatggacacataaacaaaatcagaaaaaacaatacatgaacagaatgaaaagtttaattaaaaaatagaaaccattagaaagaattaaatgacaatccagagctgaagaatatgatgaattaaccgaaaaagtgataaagagctacaacagtaaacatgataatacaggaaaaaaaaacaaaaaactggtgatctcaaagacatgttatttgaaattagccagttagagaaacaaaatgaaaagagaatgaaagagtgaagaaaagcatatatgacttgtggaacaccatcaagtgtacaaatatacaaattatgagatttccagaagaaaaagagaaaggaaaacagaaagcttaaagaagtaccggttgaaaatttcccaaatcttgagaggaatatgaacatctagatttataaagcttaggggatcccaggcatgattaacccaatgaagaatactcagggacatattataattaaattgttgaaagttaaacacaaaaaaagaataatgaaagctataagaaaaaaaaggttcattatatacaagggaactcaataccatcaatggacttctttagagtaaccttgcaaagcaagagggagttagatgatacagtcaaatgctgaaagaaaaaaaagaatacttacccagcaaaactgtctttttagaatgaaagagagataaagactttcccagagaaacaaaaactgaggaagtgcatgactactagacctgcttcacaagaaatgctgaacaaatttctacaagtttaaacaaaaagatgctgaacaacaacatgaaagcataataaagtataaatctcactggtaaaggtaactgtaatcacaaacacagaatactataacccatattaaaggaagaaagtagtcagaataattacaaatacagaaatatgttaatgacaatacaacatggaaagaaattattatgtcattaattacataaagtttgttggggggagtgaagtctagtgtttatgtgattgatgtgaagttatttcagcttaagacatgtggctatataaataaaatgttcaatgtgagccccatagtaaccacacacaaaaaatatacatcaggtagacaaaagataaagagaaaagaatcaaagcacaccaatacaagaaattatcaaaccgcaaagaaatacaagaagagaggaacaagagaaatataaaacagacaaaaaacaatttaaacagtggccaaaggcaatccttagtatccaaaaattactagaaatataaatgaactatactttttaatcaaaaggcataggagtggcggaatggatttttttaaaaaaagaaaaaaaacaaggcccaaatatatattgtcttcaagaaactaaaagtgaagagatgaaaaaagatattccatgtaaattgtaaccaaaagagagcagggtggttaaactcatatcaggcaaaacagactttaagtcaaaaactatcacaagagacaaagaagttaattatataatcataaaatggtcagttcaaaaggaagatataataattataaacatatatgcacccaagataaaagcaccaaaatatataaagcaaacattggtaaatctgaaggtataaacaaacattagcaaaataagagtagaagaccccaccctgtacaacagatggatcaactacacagaagatctgtaagaaaaccacagaaacaaagaacactgcagactacatagagctaacagacatacagaaattctaccttgtggcagcagaatacacattcttctaacgtacacatggcacactccccgggatagatcaaatgttagtttataaaacaagtcttaacatatttaaaaatgtcaatattggccaggctcacacttgtaatcccagcactttgggaggccgaggcgggcggagcacgaggtcaggggttcaagaccagcctggccaacatggtgaaaccccatctctactaaaaatacaaaaattagctgggcatggtggcagacacctgtaatcccagctactagggaggctgaggcaggagaattgcttaagcccgagaggtggaggttgcagtgagccgcgattgtaccactgccctccagccggggtgacagagcgagactctgtcttaaaaaaaaaaaaaaaaaaaaaaaaaagtcaatatcactccaagtatattttccaaccacaaaaaataaaacctaaatcagtaacaataagaaaacagaaaaattcacaaatacatagaaactgaataacagactcttaaacaatcactgggtcaaacagaaaaccaaaagagaattctaaaaacattttgagacaaatgaaaataaaaacacaacataccaaaacttacgggatacagcaaaagcagcactttttccaatgaaaaaaaaacagccaacaggaatatggaaagatgctcaaaatcactaatcagcagtgaaattcaaatcaaaatcattaacagatatcacctcacacctatttaaaaggctattatcagaaagacaaaagatagcacactttggaaagggtatgaacaggaaatgcttatacattgttggtaataaagtaaatttttatagccattatggaaaacactatggaagctcctgttaaaaaaaagagaattaccaaatgattcagcaactcctcttctggtattaaatcagtatcttgatttaaaaatattaaatcagtatcctgcagaaatatgtacatgaccatgttcactgaagcattattcataatagccaagatagaaaaacaacctaaattttcactaacagatgagtagacacaatacacacatgtatacatatacacacacaaacacacaatggaatattattcagctgtttaaaaaaaagaaaatcctgcctatgtaacaacatggatgaaacttgagaacattatgctaagtgaagtaatccagaaacagaaagaaaaatagtgcatgatctcacatgtattcagaatataaaatattagaactcatagaagcacagagtcaatggtagttgctaggtattggaggtagggaaaatgaggaaatgtcaaaggacacaaaacttcagttatgcaagatgaataaattctgaggatcaaatgtatagcacagcaactacagtcaaccatactgtattgtatacttgaaatctattaagagggtagatcttaagagttcttggccggcatggtgtctcaggcctgtattcccagcactttgggaggctgaggaaggcagatcacttgaggccaggagtttgagaccagcctagccaacatgacaaaaccctgtctctagtaaaaaatacaaaaattatccaggcataggggtgtacacctataatcccagttactggggaggctgaggcacaggaattgtttgagctcaggaggcggaagttgcagtgagcagagaaggtccactgcacttccagcgtggaagacagagtgagactttacctcaaaaatgaaataaataaaaaataaaaattaaaaaaagtgagttcttaacacatacagagaaaaaggtaactatgtcaagggaggaatatgttaagttgcctgattttggtaatcatttaacaatgtatacttatgtcaaatcaacaaattgtatcccttaagtatatacaatttctatttgtaaattataccccaataaggtgagaagaaaaaataaatataaacatgaaattgggaatatcatttataactataagggatacaaagtttggaggtggggataagcgggagaaaatgtttttgattttagatattgctacttttttaaaaggctgaatggtatcctatggtataaacaagccataatttaaatattgcccaattgttgaatatttttcttatctccattttttccatcataataaatactttaataaatgcccttgagcatacagtctattttgtattttttctatcataataaataatttaataactgcccttgagcatatagtctagattattttgcaatcatttctgtaaaagagatatttaaagtgttatatctggaataaaagtcaagaccatttatttttactttcacagacaaaaattgcttcacaaatgtatagtcccaacagaaatatagaaacatatttttctctcactttaaccgataatatatagtgtttatatttttaattttgtcccaatacagctacctttgttcatctttttctttacaaattctggaatttgaattagaaagaattgatttcacagttatagaatctctatgttatcttctaatgctttttaaagtctattgtttttcagttgattctatttaatttcctagatagatagttatatcatctgcaaataaggacagttacatcccatctcccaatattgtatctacctaaaatgtgtataataatacttagattccaaggatcataaggtctggtaaattgtagttttgtggcacagttgtgatgtttgttttcaatttcatgttgaaatgtaatacccaatgttgaaatgtgatccccagtgttgaaggtggggcttgataggaggggtctgggtcatgggggcagatccctcatgaatggtgtccccccagtggtaatgagtaagttctcactctactaggtcatgcgagagctggttgttaaaagaagcctggcacctgctcctctctcttttgctcccccttcactttttgccatgagtagaagcttcctgaggcctcaccagaagccaagcagatgctcacgccatgcttgtacagccagcaaaatcaggagccaaataaacctcttttcttaataaattactcaacctcaaatatttcttaatagcaacacaaaacagattaatacacgttgtatattaaagtaactgataactgtaaagtactacatagatgtcaagtactacacttttttagcatcaccttaatagaaggcacttaataaacatgtggaaaaccatattaaacatgaattatttgtagaagaaactaaaacttttttcataaaaaatatttggcaattataaaaaatttcaattagaatatgaaatagtctcatattaaatatatatattaaaataatttatatttatattttatcaagtaatcaaatgatatttaatagcattctgactagagatacaagtctattttcctcatatttattttgatgtatagtgaaagataagggcaattaaacttaagaaaaagtcatatttaacaaaacacaattgcccctgaattggcacccttcttagaatatggctttttagggccgggcgcggtgggtcatgcctgtaatcccagcactttgagaggccgaggtgggcggatcacgaggccaggagatcaagaccatcctggctaacacggtgaaaccccgtctttaccaaaaatacaacgtctttactaaaaatacaaaaaattagccgggcgtggtgacgggcgcctgtaatcccagctactagagaggctgaggcaggagaatggcgtgaacccgagaggtggagcttgcagtgagccgagatagcgccactgcgctccagcctggtcgacagagcgagactctgtctcaaaaaaaaaaaaaaaaaaaaaaaaaattagaagaatgtggctttttagtttttgaaggttattatcacattattatcagtgtttacataaatctaaatcaaaatgaaatatttatggcaaaaaaatactccctaagagttgctgctgtcaagttcctgggagcaaactaagagatgctgcaggtgataaccagtgtttcattagcaaatgtgaacatttgctctttattgaggactgagtgagatgtatgaatagaagatcaatagattcaatgttttatgaagtatcatctttagagccaagtccacagagtatcacaagaacatgtaaattcaaagtttcccatgctgaaaatgatttcttagtctcaatcttatcatctttaaaatagaagtaacacttgtcaacacgtgattgcagtttacatcacttatcagagctgcacttgcgtctggcagaatatcataaacatttcacatcctatctgcaaataaaatgggacggggcctggaataaagttaattcaaaacatgcttaatttcgaatttgattaatataaggaagataattgttacattaattttaataaatatgttaaaaggttaagtgttgttaatacagataggaggaattttcctcttaagctctaacatcaatattcctcaaatttaaaaatgataaatttttctattttattacatcctttcataaggaatattcatatacataaggacttatataatgttgaaactataccaaattcggatactaaatatcaaatagcaatagtaatgcttttgtttcttcagagggattaaagtgttcattttaagcctaagcaaataagagttgagattttaatatatctcatttaaaaaaataaagaagcagagaatatgattattaaggtatatagaattgaacttcatgattgaaccatctgacctaatcagcatatggagaacactgcatgcctagtgcagattgcatattctttacaaatatacagaaaacagctaccaaattacacaatatgcgggcccctaaagcaagtctcatcaaatttcaaaaacaaaattacagaccatattttttgaccaaggcattattaaactagaaatcaagactagaaaaattattgaaatttttccaaatattttgaaattatgaaacagaaataatcaatgggtcaaagaaaagcccacaatgtaaattagaaactgcttgaaaattagttatattggaaatacagtataaaagattgtgggagaaatctaaagatgtactttaacagaaatttatagtttaagtgcatatgttaaggaaaaagaaagaggagagtgacatcagcaagatggcaaaatataaacattttactctttttttaaaatctctgccccaatctactttattttgatgattcaaatgacatctttttatattgcaaatctattagcatagacttataattactttttataattttgttataaaaattattacagaaagctccagatcctcctcccacagagacacataattaacaacaatatgtgagcctatctgagaaattcaaaaacaagtaagaggttcttgcaacccatattaagagtgaagcaatctgcatcaaaacccagtaggaaaatttgtagcattctcttaccagagcctatggcatgattcggagaaaaccaccaactccccattcctcgttaggaaagggaaacagtagaatgtgtatacaacattgtgatttgggaggcttcctgggaattgttttctgttttgcctgaatctaactactggcagtaacaggtgtgccacattgtagccacttagaacaaatgcaatcaacctgccccagagtctgcagtaacgcatgcagacactagttgaagctccaataccatggcttactatggcaccagagacactgcatgtatcacaaactccagggaaaactcctgggtagaaacaggcaaacatcctcaattaggagattacaagcacaagcccaaagaggacatatcatcagaaaagatttgagaagtctccagaatctctaggtgggctgattttaaaaaattctccctatacaaatccagattacaaagtctggaaaaagtggccgattatttaaatgataaagtccaaacaaaagataacaagacatacaatgaaacaggaaaacatgtcccagtcaaagaaacaaattaaaaagagactccttatgtacatgggggcttttattatcagcagatttttctgcagaaaccttatagatgagaagggaataagatgatttatacaaagcactgaaagaaagaaaaaaacctgtcaacgaaaattagtgtatctagcaaaaccacccatcaaaaacaaaggataaattaagactttcccacgtaaaagctgagggagttcatcaccactagaccttccctataagaaatgctgaagggaataatttaagttgaagtgagagaataataaacagcagcacaaaaccacatgaaaatataaaattctctggtgacagcatacatataggcaaatatagaatcctgtagtattacaatgtaagcatgtaaacttttaaatcaagtgtagaattttaaaaaacaaaattataaaaagtaatagtaagtctatgctactagatatgcaatataaaaagatgtcatttgagtcatcaataaaataaagtggatggggcaaagattaaaaaagtcaagtttttatatgtgattaaaattatccatttaaaatagattgttacaactttaagattctttatacaattgcaatgataaccacgaagaaaatatctactgaatattcacaaaaaaaatcagaagagaaattaaatgtgtcaacacaaaaattaaacaaaacaagttaaggcagcaaggaagaaaaggaagaacaaaaagctacagaacatgcaagacaaaagcacaatgccaatggtatttcctatcagtaattactttaaatgcagatgaattaaatgtcccaatttaaaatcataaattggatgaatggataaaatatcttcaaccaagatgcagctatatactgtctacaagggactcagtctagaccctggaatgtacacattggttaaaagtaaaagaatgaaaaaggatagttcatgcaaataggaacctaaaaagagccatatttacaatagagaaaataacctttaagataaaaactgtcacaggagccaaagaaaaacattatattaatataatgaaaaaagctaaattcatcagtaagatataattagtaattataaatatatatacacctaacattagaacttccaaatatgtgaagcaaacactggcaaaactgaaggaagaaatagacagcaacataataataataatatgagacttcagtacactttcagttgtggatagagcaaggagacagaacatcatgagggacacagagaacatgaacaatactgcggagcacttggacctaacagacgtaaagagaacactccacaggccgggcgcggtggctcacacctgtaatcccagcactttgggaggccaaggcgggcggatcacgaggtcaggagatcgagaccatcctggctaacacaaaccccgtctctactaaaaatacaaaaattagccgggcgcagtggctggcgcctgcagtcccagctactctggaggctgaagcaggagaatggcgtgaactcaggaggcggagcttgcagtgagccaagatggcgccactgcactgcagcctgggcgacagagcgagacaccgtctcaaaaaaaaaaaaaaaaaaaaaaaaaaaaaaaaaagaacactctgtaaacaacagcagaacacacattcttctctagcgcccatggaacactcttcaggatacaccaatgttacacacaaaacaagtccttaaaaatttaagatttaaattacacaaaaatatcttctctgacaacaatgaaataaaactagaaatcaatagcagaagaaaaacagaaaaatccacaaatatgtacaaattaaataatacactctcctacaaacaatagatgaaagaaaaaaatcaaaagagaatttagaaactgtggagacaaatgaaaattaaaaagatgggatgcagcaaaagcagtactaagaaggaagtttatagcaacaaaaactcatagcaataaaatacttacagcaataaaaatatttacttacattaaaaaataaaaaatatctaaaatcaataacctaacttataacctaagcaactagaaaaagaagaatgagctaaactcaaagtcagcagaaggaagtttaaaataataattaaaacaggtataaatgaaatagaaaataggaaaacaattttaaaataaaaccaattgttggttttttgaaaaaataaataaaacccttcggtagacttaagtgagaaaaaaaagacgactcaaataaattaaaaccataaatgaaaaaagagacattacaactaatgtcatagaaataaaaatgattatgagaatactatccacaattatatgccaacaaatcagatgaattagataaaatggataaatttctaaaagcatacagtctaccaagactgaatcattaataaaaaaatatggagagagctggtaatctcagcactttgggaggccgaggtgggcggatcacaaggtcaggagtttgagactagcctggccaacaaaatgaaaaagagatatcacctcaaacccactagaatggccactatccaaagaaccaaaattaacaatcattggtgaagctgcagagaaattagaacccctgcacactgttggtgggaatgtaagtttctatagccattatggaaaacagtatagaggttcttcaaaaaattaaaaagagaattactacatgatccagcaatcctacttctagatacatatcaaaaagaattcaaagcatgatctgtaagaaattttgcactcccatgttcattgcagcattatctacaatagccaagaggtgaaggaaacccaaatgtccattaacagatgaataaataaagaaaatgtggtaaacacacacagtggaatatcactaagccttaaagagggaaatcttatacatgctacaacatggataattgaggactttatgctaagtaaaataagccagtcacaaaagaaccaattctgtatgattccactcatacgtagtatacaaagtagtcaaaataacagaaccagcatgaaagaaatccattcggcaagggctggaaagaagggagaggaggaaacagtgtatagtagatttagaatttcagtgttgtaacataaaaaaattctagagatctgttgcccaacaaaatcaatatacttaacactgctgacatgtacacttaaaaatgattacgatggttaaatttaaaaattatgtcctttttgccacaatttaagaaaagaagaagaaagataaaaaatccatgatttaagcttacttctaaagaagattgaaaaaatggcaagttaagctcaaagaatatttacaaaagaaaatataaaaaataataaaagaatgaaatagaagaaatacatgagagataaaataaattcaacaggggtcagagccaagatggttgaataaatgcagccaggaggaacacttctaaccaaaagactgggacattgggaagaccggcatatttcaagcagatctttggaagattgagagtgaatggcgagagaatgcagacactgggctgaaggaggaggaagctgggatacatgcacaaggctgctgagcactgggactcatttctagacaccagtggctcctggggaagagatgagttgaacaggtgaggattggaatgctctggccatggatctctggaatcctagatggagtagaccacaagaccactgtggacacttgagctggcagagagagctgcttagaaaggtagcagaggcaggacttcagccagcgtggagctcagagggtttggcacaggaatggcagcagtaaagcatggccacggatgccccgcccccccaaggctcaacatgctccactaggtggctttagtctttgggtaactattggactaggacagagcagaggagtctcgcccatgggatctgagagccccctttctgctagcctcttctgggacacgaacctgaaaatactcgcttgcagtacagcctcaggtgcccaaccagagttcttcctaggaaccctcatgataacttcttcaccagcagaccacgcctagctgtcgaaggatcaagcagacccgtccataccaaaacgcacccaaccacccacagctaccccctacagaaggctccccattttgccagcatgaactcacccacgcgccctcctcccatgactttgctggtgtgtatgcttgggcagatcttccttcccctaccccagtggcatgtgtgtgctcgataccttgatgccccgccttgcaggtccaagtacatcctgccaccccacctctgctgacatatggacaccctgccatgccactgtcatcagcataagggcacagatgttatctggcccatcagataacaaagccaggcacctgatactagccgccagggctggagcatgcagcccaggaatgttgaggtgaacaatggtctcttgaaatcttccagaaaggaagccagtcaacagaatacaacttatgccacaatcaaaccttcaagggtgtcaaagaagataagagaaaaaaaaaagtctaaaggatagcaatttgaaagattaaggagcatcagcccatgccagatgagaaagaaccagtacaataaccctggcaactcaaaagcccagagtgtcttcttgcatccaaatgaccacacgagtttctcagtaatgcttcttaactatttcaggctgaaatgacagacatagaattcagattatggataggaacaaagattattgagattcagaagaaagccaaaactcaaagagatcaaaggaataaaataaaataatagagcagtggaaagatgaaatagccattttaagacaaaaccaaactgatctgatagagctgaaaaactcactacaagaattttataacacaatgacaagtgttaatagcagaatagaccaagctgaaaaaagaatcttggaccttgaagactggttctttgaattaagtcagtcagacaaaaataaagaaaaaagcataaaaaagaatgaaccaaacccctgagaaacatgcaattatgtttaaaaatcaaatctgtgactcattgacatccctgaaaaagagggagaaaaagtatacaacttggaaacatatttgaggatatcacccaagaaaatttacccaaacttgctataaaagccaacatttgaattcaggaaattcagagaactcctgtgagatatatacaagatgacaatccccaagacacataatcatcagattctctaagattgacataaaagaaaaaatattaaaggcagctagtgagaaggggcagctcacctacaaagggaaccccatcagcagacctttcagcagaaatgctgcaagccagaagagactggggatctaaatgagcattcttaaagaatcacacttagaggaactagaaaaacaagaagaaaccaaccccaacaatagcagaagaaataaccacaatcagagctgaactgaaagaaattgagacgcaaaaaaaatacaaaagatcaacaaaaccagaagttgtttatttgaaagaaaaataagattgatagactgccagctggactaataaagaaaaaaagagagacgatccaaataaacacaatcagaaatgacaaagaagacattaccactgaccccacagaaatacaaaaaaaacctcagagactattacaaagacttatattgacacaaatgagaaaacccagaagaaatggaaacataccacctcccaagactgcactaggaagacactgtatccctgaagagatcaataatgagttctgcaattgaatcagtaataacaagcctaccagctgaaaaaagacctggaccaaacaaattcacagtggaattctatcagatgtataaagagctgattccacttcttgtttctaataaaactattccaaaaaatcaagaaggagggacacctccctaactcatcctatgaggccagcacattgtgatatcaaaatctggcagagacacaacaaaaaaatgagaaaaattcaggccaatatccttgatgaacatagatgcaaaaatcctcaaccacatactagtaaaccaaatccagctgcacataaaaaagctaattcaccacaatcaagtaggctttatctctgggatgagagattggttcaacatatgcaaatcaataaatgtgattaatcacagaaacagaactaaaaactaaaacgacatgatcatctcaatagatacataaaaggctttcaataaaattcaacatccctttacattaaaaactctcaaactaggcattgagttaacatatcttcaaataataagggtcgtctatgaaaaacccatggtcaacatcatactgaatgagcaaaagctggacgcattccccttgagaactggaacaacacaaggattcccactctcgccattcctattcaatatagtactggaaatcataaccagagcaatcaggcaagtgaaaaacataaaaggcatccaaataagagaggaagtaaaattatcctcatctgcagatgatataattttatggctagaaaactccatagtctctacctcaaaactggatctgataaacaacttaagcaaagtttcaggatacaagatcagtccatttctgtgtactaagaatatccaggctgattgccaactcaagaaccaatctcattctcaatagccacaaaaagaataaaataccttggaacacagctaaccagggaggtgaatgatttctacaacaataattacaaaacactgctgaaagaaatcagagatgacataaacaaatgggaaaacattccacgatcatggataggaagaatcaatattgttaaaatggtcatactgcccaaagcaacctacagcttcaatgctattcctgtcaaactaccacgagattcttcatataactgcaaaaaaaaatctgaaattcatacggaacaaaaaaagcgtctaaatatccaaagcaaaaagaacaaagatacaggtgtcacattacccaacttcaaattttattacatggctacagtacccaaaacagcatggtactggtagcaaaacagacatacaaaccaatggaacagaatagagagcctagaaataaatccacacacccatgtacaaccataacatcttcaacaaagttggcaaaaacaagcaatggaaaaaggacccccctatttgaaaaattatgctgggataatcggccggcccatatgcagaagattgaaagtggactccttcctgtcaccatatacaaaaatcatctcaagatggattaaagacttaaatgtaagatctaaaactataaagaccctaggagaaaacctaggaaacaccatttcagacataggcgctggcaaagatttcaggatgaagatgccaaaagcatttgtaacaaaaattgacaaatgggacgtaattaaactaaagagcctctgaatatcaaaataaactatcaacagagtaaagagacaacctactgaataggagaaaatgtttgaaaactgtgcatctaacaaaggtctaatgtctagaatctataagaaacaaacaaattaacaggcaaaaaacaaacatccccttaataagtgggcaaaggacatgaacagatgcttttcaaaagaagacaaacacacagccattgaacatgaaaaaatgttcaatatcactaatgagcagagaaatgcaaatcaaaaccacaatgagataccatctcacactagtcacagtgactattacaaaaaggtcaaaaagtaacagatgctggcacagttgcaaagaaaagggaacacatatataccgctggtgggaatataaattagttcaaccattgtgagaagcagtttggcgatttctcaaagaacttagaacaggccggatgcagtggctcacacctgtaataccagcactttgggaggctgaggtgggcagatcacgatgtcaagagactgagaccattctggccaacattgtgaaactccatctctactaaaaatacaaaaattagctgggtgtggtggtgcacacctgtagtcctagctactcgagaggctgaggcaggagaatcacttgaacctgggaggcagagattgcagtgagccgagatcgcaccactgcaccccagcctggggacagagcaagactccatcaaaaaaaaacaaaaaaaaaacaaaaaaaaacctaccatttaactggtaatctcattattggtgatatacccaaaggaatataaattgttctaccaaaaagacatgcatgtatatgttcattacagcactattcacaatagcaaagacatggaatcaacctaaacgtccatcagtggtagactggataaagaaaatgtggtacacccatggaatactacacagctataaaaaggataagattatgtcctttgcagcaacacggatgcagccgaaggccattatcctaagtgaactaatgtaggaacagaaaaccaaataccacatgttctcactcattaagtgggagctaaaccttgagtatacatggacacaaaggtgggaagaatagaaactggggcctacttaaagagtggaggatgggaggagagtgagggtggaaaaactccttttgggaattatgcttattacctgggtgatgaaataatctgtacaccaaactcccacaagatccaatttacctacgtaacaaatgtgtgcctgcacccctgaaactaaaataaaagttaaaaaataatgataataaagtcaacggttggtcctttgtaaagactagtaaaatctataaatttctagaaaaatgatagaaaaaaagagaaaacaaaatcattaatatcaagaatgaagaaaaaaaagacatcactataaatcttagagatgttaaaaatacaaggaggtccacacaaaaacctacacatggatgcttatagcagctttattcatagttgccaaacctcgaaaacaagatgtcccttgataagtgaatggatgtggtgcatccaggcaatggaagcattaaacaggggagctatttaactcacaagaatacctggagaaactttgaatgctcattactaagtgaaagaagccaaatttaaaccaccacacacagtctatgattccacctatatgacattctagaaaaggcaaagctttggagacagtaaaaagatcagtggtttccagggattaggtagagaatgggatgaataggcagagcacagaatattttcagggcagtggaactattttgtatgatattacaatgatggatgtagatcattatacatatgtaaaaaaccatagattgtacagaaccaagagtgaaccctaatgcaaacttggactttgaatgataatgatgtgttaatgtaggttcattgattgtaataattgtaccactaaagtgtgagatgtgggaagttgtgcatttatgtaggaggggctatatggaaactccctgtactttccacgcaattttgcagtgaactcaaaactctaaaaaatgaaatctactaaaaaacatatagacaaggtgtggtggcatgcacctgtagtcacagctcctggggaagctgcaggagtatggcttgagcccaggagttcaaggctgcagtgagccatgattatgccactgcactccagcctgggtgacagagcgagaccccaactcaaaacaaacaaacaaaaaaaactaaaaacagcatatagcttgttgggggagggtgggcatgggagagcatccgggaaaagagttgatgcatgctggtcttaatacctaggtgatgggatgatctgtgcagcaaaccaccatggcacacgcttacctatgtaacaaacctgcacgtcctgcacatgtatccccaaacttaatttaaaaaattaattttttaaaacagcatataataagaaatcatgaaaatgtagataaaataattaaatttcttgaaaatcttttaccaaaaatagcaacaaaaatatcatttatttgtactaaatgtattaaagtaattcaaaccataattaaagaacaagctacggccaatccgataaaatatatggaagacctctacacagaaaactataacaattactgagtgaaattttaagtgttaatagagagctaaaccaagttaatgattaaggagattcaatatttaaacatgtcagttctcttctaatgttctcttgattcgatttatttctaatcaaaatccttacatgtattctgtgataagctgattttaaaacttatatggaaagtcaaagaactaagaatgactaagtgagtcatgaagaagagcaaagttagagaatttccctatctgatatcaagacataaactcactgtaataagacagtgtgatattaggacaaggtttgagagaaatgggttattggaaaatagcagagagttcataaacaaatccacacatatatggccaccagccttatcatctatgtagtacagcagggtagtggggaaaggatgcctttttctttttcaataaatggtactggataagctggatattattaaatgggaaaaaggaagtaaacttggtccccattttgcatcatattctcaaaacacaattccaggtgaatttaattttaaatgtgcaaggtaaactactaaagttttagatgaaactgtaaaacgcctttgtgactttgggacttgtaaagatttttaaaactgaacacagctactaaccattaaaaaaaaaccctattcaactttgttaaaattatgattctctaggctcaccaaaagacatcattaagagcgtgaaaaggtaaagaggaatctacatacataaatttataaatatatacttgtatgtatcaagacatatgtatctccaaaattataaagaacatctataaagaccatctaatagacaattggacaaagacatgatgaaaagctacttcacagaagaatatattcaaatgggcaaacgtgcccatttcaatcattagggaaatgcaaattaaaaccacaatgaaatactaccatgtacctgtgagaatattagtatgaaacacacacacatgacaaaagcaaaagtgagtaaggatttggagcaactaaatatcttgtacattgctgttgggaatctaaattgataaaatttattgggaaactcatttaggttttatactagctctaagtacgacgtggaaattttactcttagtaaatacccaaataagcgtatgtatactcataccagctttatttgtgctagccatttaaacaaatgctaaacctagcctaaataactcaagatgatagaaatcagaatattgatgattttggggagagtgcataatatcagggagggacatgagagatatccccgtgatgctgataattttctatgtcttctgctgagtgatgtttatgctagtgtatttacctaatagttaattttagatctatatatcttatgcaattatactttaataataaaaatcgatgcccccctgccccaacaaaatgagatagcaacttaaaactgtccttaaggaatcacagttttacttatcatcaatacttggtttagaacaccagctggttctaaactccaaacccttagggctacatataaaagagacctaattttaaaacagtttatagactaattagtaaattatgtaaattccaatttatgtgttctaatagtttattctttgttgtacctcattaacatgcaaaaataaagcattttcatcatttacttttattgacccatgtttacctcttatgtccataatatcaacatagtcatatgaatgcattacatttacaaatatttatatgcagttaatacctaatagaattcagaaaagtctgacatttttaaaaacttgtaaatggtgtgaagaaattaattttgaaattcccattttcgtcactacccagctactgaactgggaaaaaatttattatttctaggttgtagacacaagagtggtttgagcttgggcttgtcacttaatctctttgttgggaggtaagttatcagaaatcaatagcctattttagacagtcactgaggttggttctaattctgacacactaacttaaatgtaaattcaaaaggattccctgaaagagagcatctcaatcagtctttttattgctgcctgatatggggaatgcctcatttcctccataattttcttgaatgattaaattaggaattaattgaagacaggtgattatttccagcttgcccagcatcaaatatattgacttttctttgattgggcaagttttacttagtaccctccaagccacagttaataaaccatcacttacattttcccagacatattaatcacatgacagatgtttgctgcctaaagagacaccaacttataaaggacagatgtaaatagaagagttaattaggcctaacaatcaacctcttagatttttatgaaagtgtgaactcataaaaaaaaaaaaaaaaaaagaaagtgtgaactcaatgccacaatttggcatgacttgtgttttcaccatatttgattaaggcaagttttaaaatcttccttggaaaagacaaactagcccattttatattttaaattatttaaattatatttttctcatttttttagaaatgaattattttcaaagtacaatttgacataaataaacaaatatttttgtgtgtttttttgagatggagtctcactctgtgaaccaggctggagtgcagtggagtgatctcggctcactgtgacctctgccccttgtgttctagtgattctcctgcctcagcctcctgagtagctgggattacaggcacgtgccaccatgcctggctaatttttttgcatttttagtagagaagatggggtttcgccatgttggcctggctggtcttgaactcctgacctcaagtgatccacccgcctcggcctcccaaagtgctaggattacaggcatgagcaactgctcccacccaacaaaatatgttaatatcaaatgtggcataaatttaaacaaagggaatatgtaattgtttcagtcaggctgtttcaacaaaataccatagattgtgcggcttaaacaagagattattttgcacagttctggaggctgggaagtccaagatcaaggagggagcccattgttttctagttgcggggagaggaagcaacctgatctctctcttcttcttacaatgacactaattccataatgggggctctactctcatggcctcatttaaacctatttacctcccaaaggccccacctccaaatcattactttcaggcttaggacttcaatatatgaattttggagagacacaaacatacagtttacaatgtaattttacaaagaaagggacaagagcattctaggcaaataaaaccgtacacagaaaatcacaaggagtataggaaagtaagttacaaatttcatcacaacagaataagcaaggcatgtaatgggagatcaaactgaaaaggcagagtttgatcacaccataaagagatttttatgatacatggaggcaatattttcttctcagcaatgagtgttcatgaaagatcaagagaagggtgacaaatcaaagcattactttaggaaattttaatccgaaagaatgcttggaatgtagcaatggaagatttttccaaagagtatataaaaatgcctagcatatattaggaccccaaaactatttgtaaaatattgaatatacataatattttacaggagtataatattttaactttgaagggatatatatcattttaactttgaaggaatatatgtatatatatataaagggatatatatatataaagggatatatatatataaagggatatatatatataaagggatatatatatatatatatatataaagggatatatatatatatatatatatatatccctttatatccctttaaagttacctcaattcctttttgtgaatgaagaataaaacttctgtgtaatgaaaacatctacatatcctttcttcctggaatagtttcacccacttaaagacctcatcacaatccacaactacaaacacaccacacacacaaaaccccttccgacacacattgttctttattttaagcttttcagcctcccagaaagaagaaattgtgatttcttttctaataacattgggagcttattcacaataaccaagatatggaaaacaacaaaactaagcataaattagggtgtccttactaaaatcagacaaagtagtcagaacattttataacaataattagcaatgtgtatgcattcaatatcagagcatcaaaatacataaagtacaaactgataaaactgaaaaaggaaatagacatatccataattatggttggatatttcaatatttttgtatcagaaatgtatagaataagaaaacagaaaatgagtagaaatatagactatagaccagaacaatattatcaaccaactttatctaattgatatttatgggacactccactcaacaaccatagaaaatacagaatgatatacagaattcttttcaagtgcatgtcaaatatccatcaagacaagtcacaggaccataaaacaagtcttaaaaaagttaaaaagatcaaagtaataccaaaaaaattttctgatcacaatgcaataaattagaaatcagtaatagatagctatctgacaaatattcaatgttgacaaatgaaacaacacatttccaaagacctatggatcaaagacaaagtcataagaaaaatcataatatagttttaaatgcatgaagagaaaaataaaacatcaaaatttaagatgcagtcaagacaccaatagaggcaaataaggatacagggctaaagttaggcatataactttcttctccaactggtgtgaaagagaaaaaaattaagcccacataaggcaaaaggaaggaagtaatatatgaaacacaaaatgaaggaaaactagaaaaaaaatcaatgaaatcaaaagatttttataaattatatcagtgaaattgatacacctctagctagattgaacaagaacacaaggagataataaatattactaaaaaaaaagacaagctataaaattggagaaaatattcacaaactatgcatctgacaacagccaagaatctgtaaggaacttaaacaattcaacaagcaaaaaaatgaataaccctattaaaaagtgggcaaaagaggccaggtgtggtggctcatgcctgtaatcccagtactttgggaggccaaagttggagaatcacctgaaaccagaagtttaagaccagccatggtaacgtagccagaccccaactctaccaaaagaaaaaggaaaaaaaaaagtgggggaaaagacatgaacaaacacttctcaaaagaatatattataagtggccaataaacatatgaaaagatactcaacatcacttatcatcagagaaattcaaatcaaaactacagtgagtcaaaatcaaaatcacaccagtcaaaatgagggatgctggtgaggttgtacaaaaaagggaatgcttatacactgttggagaggggagtaaattagttcttccactatggaaatcagtttggtgatgtctcaaagaacttaaaacggggctaccatttgacccagcagtcccattactgggcatatagccaaaggaaaataaatcattccaccaaaaagacacatgccactcatacggtcatagcagcactattcacaatagcaaagacatggaatcaacctaggtgcccaacaatgatggtggattggagaaagaaaatgtggtacatatatgccctggaatactatacagccataaaaaagaacaaaatcacgttctttgtatcaacatggatgcagctaaaggccattattctaagcaaattaatgcagtaacagaaaacgaaatactgcatattctcacttataagtgagagctacgtctttggtactcatgggtgtaaagatggaaacaatagacactggagactactagaaggggagggtgggtgggagaaaaaatgttgaaaaatagttgaaaaactattggatattatgatcattacacaggtgataggatttttacatctacattcataaggaatattgatctgtaactttctattttataatatcgtttgctttttcttttctttttctaatcaaagtaccgttggcctcatacaatgagttgggaggaatttgcttctcttgtacttgctgaaagaatttatataaaattagtggctgggcacagtggcccatgcctgtaatcccaacactttgggagcccaaagcaatgatattacaatataaaaagctacagaacaatatccttcattagtgtagatatgaaaagtcccatcacctccaggtagtgagcgtagcatctaatagttattcaattatttttagcccgttttcccttcttccctcctccctctagaagtcccaagtgtctgttgttcatattccaaacctcagtatcacgcaatgtacccatgtaacaaacctgcacatgtactcccgaaactaaaagttgaaattattttaataaataaataaatgctactaaagccaagatgaaacaaatatcataactgcaggtgctgcatatatattaaagcaataataaaagaatattttgaaagcttaatgctaaaacgtaatttagatgaaattgacaaatgcctttaaagacaaaaattacaagctactcaagaaaaatagaaaagtctgattagttatatatttattgaggaaattaaatgtataatcaccaaaacattttatgcaaagaaaacttctggccctgataaattatacaccagtgaattatacactaggaagaaatgatactaatatataaggaagaaatgatactaattttgtttttttttttttaatttattttttccagacagggtcttgctgtattgcctaggctggaatgcagtggcatgatcatagttcactgcagcctcaaacttctgggctcgagtgatactctcgtctcagcctcctgagtagctgggactacatgtgcacaccactatgcctggctaatgtcttaaattttctgtagaaacagagtgtcagtatgtttctcaggctggtctcaagcaatcctcttgtcttggtctttcaaagtgctggcattacaaatgtgagccacagcgcacattcactagttttatataaattatttcagcaacttcaagaaaagtaaacacttcccaactcattgtataaggccaacattacccccattaaaaaaataagatgacagggtacagtggctcttgcctgtaattccaacactttgggaggctgaggtgggaggatcacttgagcccacaaatttaagaccagcctgggcaacataacatgaccttggctctataaaaaatacgaaaattagctgggagtaatggcgcacacctgtggtcccaattattcggaaggctgaggtgggaggattgctttgagtccaggaagttgaggctacagtgagccaggtttgcaccgctgcactccagcttggacaacatagtgagaccctgtctaaaaaactaaaataaaataaaaataaatgataaaacaacaaacaatgatattacaaagcaaaaagctatagatcaatacccttcataaatgtaaacatatacatctttaataaagtatgaaaaataggatccagcaacatgaaaatcttaatgtatcattactagttagggtctaccccagatatgtaagattggtttagcattcaaaataagttaatgcaatttagtgcattaaaacaacaaagtaagaaatcatatgatattctcatagatgcggaaaaaaaagcatatgacaaaatttaacataactaatgattttttttttttttttgagatggtgtcttgcccttgtcgcccaggctggagagcagtagtgcgatctcggctcactgcaacctccgcctcctgggttcaagcaattctcctacctcagcctcctgagtagctgggattataggcgcccaccaccacacctggctaatttttgtagttttagtagagacggggtttcaccatgttggccaggctggtctcaaactcctgatatcaaatgatccgcctgccttggcctcccaaagtgctgggattacaggcgtgagccaccgcacccagccatgatttttaaatatcccagaaaattataaatagaaacgtactccttgacctgatagaggacacttaagaaaaatttacagtaacatactaaacagtgaaagactggatgctttctctttaggattggtagcaagacaagaatctctagttaaatatgatctcctccccatctacacctactttcaccacttccatttaacattgtattggagatcctagccaatgcaacaaggcaaaaaaaaaaatttaaataaagtaaagaacatacagattgaaaaaaaaaagaacaaaagttcacgatcctgtatgtagaaatcctaagaagtctacaaaaagccactacaaagagttttaaaaaattagttcagcaaattcacaggatataaggataatataaaaatcaaaaatcaattgccttctaatatactagcatttactgtaaaactacaataatatagtcaatgttgtattattgtatgaatagaaatgcagcttaaacaaacagactgagacatgcatatgtagccaactgatttttgacaaagatgtgagttacttcaacagagaagtacctttcagcaactgatatccatttggaaaaacaatgaacctcaactattatcacatattttgtaccaaaattaacttgaagttaatcatagacactaatataaaggcaaaaactttaaaacgtgtataagaaaacacagagaaaattttcacaatctaatatttcttaaatgagaccccaaaagcccaaataaaaggaaaaaaatgataaattagaattggtcaaaataaaaaatttccgttgctgaaataaaataccaacaaaatgaaacaagttttcttacacatgtaggaaaataatatttactaaaaacatatctgacaaaggattgaacttcaacatatgaacaacccttacaaatcaacaagggaaaaaaaatctcacaaatgatttcaatggatccttacaaaaaataggtatatcaatggccaataagcacatgaataaatatttaacatcattaatctttaggcaaatgcaaagtgaaaccgtcatgtgatgccaaaacacacacattagaatgactaaaagaaaacttaagagacggtaatgaaattaaagttaaaaagatttacggtatttgggttctccagagcataaaagcatttactataaggaattggctcacacaattagggtggctgagaagttccaagatctgctgttggcaagctggagaccttggagagccagtggtatagttccagtctgagtttgaaggaatgacaaccaggaaagccaattgtgtaagttttagtccaaaaggcagcaggtttgagatccaagaagagctgatgttttagattgaacccaaaggcagaaaaagaccagtgtttcatctcaggcagtcaggcagaagttctctcctacagggaggtcagccttttgggtctgttcaggccttcaactgattggataaggcccacctacattaagcagggcaatctgctttactcagtctactgattcaaatgttaacctcatctaaaacaccctcacagatacactcagaataatgtttagtcaaatatgttggcaccccagtcaattcgacatataaaactaaccgtcacacttaccataccaagcctctttgttgaaggaaacgtacaaacctgttgggaagaagtttggtaatttcttataaagttttaatgcccttactttatgacctagtaattaaatccccaggtatttatcagagaaataaaaacctgtgaccactcaaatacctgtgcataagtgatcttcattaatagtaattgttaattattgttaataaagattatttattgttattttattttattttaaattctgggatacatgtgcaggtttgttacataggtgaatgtgtgccatggtgtttcgctgcacctatcaacctatcaactagttattaagccgcacatgcattagctatttaagtttattgttaataaaaattatttatgtacaataaattcaaatctttattgtttagaaatttgtgcaaagaacacagcagcccacagaattacttgtacataaattatttttattcataattgttaaaaactggaaacaaccctagtatttatccacagacacatggcctaaaaatgtggtatattcataaaatggaatatttctcagcaataaaaagaaagaaattaactactcatacatgcaacaacacaaatatcaaaaatacaccaagtgaaaaaaaaaggctcgtacaaaagaccacatactatagaatcgcatttatatgaaactctagaaagacaaatataatctatagtgacagtaaacagcaagagttgtctttgctttgggctggaatggaaaaattttttagaacagcttgtaggaaattttgtcagagtgatggaaatgttttatatctcgattgttgtagtggttacccaggtgtataaatctgtaaaaactgtatggacagaatatttatgtcccccctaccaatttatatgttgaaatcctagccccccagtgtgttagtattaggaagcagagcctttgggagggaattaggtcatgggcattggattaatgtctctataaaagagaccccagaaacttctcttgctctttttccactatgtgaagatagaatgagaggtcagcaatctgcaactagaagaaagccctcacctgaccatgctgacaccctaatttcagttgttcagcctctagaactatgagaaataaatttctgctgtttacaaatcacacaacctattgatggtattggtactttattatagcagccagaactaagacattcatcaaattttacatttaaaatagatacattttgttatatgtaaaatttatctcaataaatttgatttagggaaaataggaatacacaataatgtcggaatttaagactgatcaaatattaaattgtaaattaaattgataaatgttaaattgttaacaaaacctggaaatttaagaataactactagtaacaaataaaagtgactataatttattgagtacttattagcggtaagatactctgctaaacacttgaatacattattttattttatcttttaaaattaacccaaaggttaatactcttaatcccattttacagatgaagaaactaatacctagtgagtttacattcctagacaacattcatgttatcacattcaactgagtggcaaagctaggtcctcgttccagccatgagtaactcaaactactccattatattttactacaattttcattacatttctagaggaataagaatagaaccatctagaaaaaaatcttagatggattttatatttagaaataacagtgtgcaattgagaaactagattacatttcacatacttttagtattgcttaagcattgctaagagtttggaatcctttgctaaacatttgctttatgtctcagctgacacaagtagatgagaaataaacaacacaaagcagcattgtagtacaagctctggaccccagacttccaaaggaaagtgatttaccaacagctcattaatgtagcccaccgtggaccagaatatatatagttgaatggtttccatgccactgatgctcatttggtttcagggtatcaatctgaactataatgaacctgaagttaaagttggactgcttcagtagctcaactccagttgattcagagttattcagtggtgcctctgtggggtcatgaactgaattaaacccaaaggcctgaattcctttgttaaccctgaaaccaccccaacttccttatattccttcagatcagtgaattatccagaacaaagtttgaccttcaaagttgtttggaacaaatctgagttcaaaattaagcagaaccttgctacttttttttctaacttctaatagaatatgtttgtatagtcatttgttactcattcagaaaactaggaaatatttaacttttgttctcccaattccattgccatattccaaatacaaaaaatgttataattctaagattatctcaatgaggaaacaacgttagaatctatttaaggataaagtcatattccatgaagaacatatattacctgtcataaattagcttttgacaaaaggaatttaggcctgtgttaccaaatactcatttataaacacagtaaaacatgagttttgcagaatatctttagatttctatggggaaaaatcatttcctcttcagaaaaatactggctagaatttacatggaaaactgcccttttgaaacattagtatatttggatccagcatatgatatgaagaaaattattatttgagaacttttaacattgaagtgcctgcccagtggctcagaccttactccttttctcttctctgtgtatactcacatatctactctctgtatatactcactttattctctgtgtatactcactttgtctactctatgtgtgtactcacttatgtattctctgtgtatactcatttatctattctcatgtccatagacagacagtcatcactctcattttgtggccctcctgaattgtacattcaactgttctttcaacctctccactaggatttccaactagacatgatctcaccaactctacccaaacatattcatctgtactctttcccatcttactcgattgcaactctgttcttccaggtaagtatgccaaaactcttggaatcatctttaactccttactttttctcaaacctccatccaaagcatcagcaaaatcttttggctctatcttcaaaatatatccatagttgaactgtttgtcaccaagtccactgctataccctgattcaagccaccatcttccatctgctcttcctgcttctattcaagtcccaccacaaccatctagtctacacagagcaaccatcttgatccacttaaagatcatctcacttttcaactctatctactgaaaccatgcaatggctcaaccagggtcatttaccaaagaagtcgatgcaatgaccatggcctacaagacctacattatctacttgtcctcccattatctctttggacatatcttctacctctctccccacctggccacattgcttcatcttttgctatttctcagaaactccagacagatttctgctttcaacttttgcactagctatttattttgtggaaaattcttgctctaaatatctaaataggtagcattatcacttgtctcaagtccttccccaaatgccacctattttgtgaggtctaagctgatcatttattaaaacttcaaatcaaattcccctgacacacctcattcccattacgctgctgcatttttctttaccatgcgtctccttcggaaacaccatgcaatttactaatttattatatttgttgtgttttattggtctccccacactagaaagtaagttccacaagatgaggaatttttatttctttttgtctctggtatctccagtgagctgagggcagcgctttatacaaaatatgcatcttgttgaacaattgaacatataaactataagacaggaaatttctacccattcattcagccaatatattgaatgcctactgtgtgccagtccgtgtactagcattaggatatagtagacagaagagatacatggtacctactcaaggggctcacagtctgttgggaagaccatcagatgctccagtcccttatataaaacagcatagtatttttataaaacctatgcacaccctcctgtatactttaaatcatctcgagattacttacaatacctaattcaatgtaaatgctgtgtaaatagttttttcaaatagtttccttctatggttgattgaatccatagatgaggaacccaacgaatatgaagtatgtgcaaagtttgtaaagtgagaaagattttaaaatgaccagagtttttggagcataatgaatggatgggagaacagagccagacaaggttaaagaagttagcatggactagatcatgcccagctttgttgtctgtgagagggttttaaatttatcctaggtgcacactctctctctcacacacacacacacacacacacatacaaagatgctaaagagagttaaatgcaataatgatgtgatgccattttgggatttgcactgtcattctgcctattgtatatggaatgacgttaaaagagaacagaagtagaggcaggaaaaccagtcagagtgcaatgacattattttcaccgagggatgacaggatgacatacaaatatgacctgggtggtgactgttgagaaggaaacataaagtatatttttaaattaggtggtcaagctggtgacggattagatatagaaacagatatgatttcccagtttctatcataagcaaatgaatggataagaaataggtattaagataataaatcactaactgactttatgggaagattgggattaagaagcaaatgatgaaaagaaaaaattaagtccattgttcaaatttatttaggttcacttttgtaatcattctatattttatatactgtgccccaaattgccctggaaggctctacaagaatgctcatgtctcacaattttgtacagaatgaacaaagggctggatatttccacgcatagcaaatctgttacatggtgtccattatgactaattctgaatatcatattttttgtttcttataccagtgaatgtgtagagtcagtcttcctcaattctcatattaatgaccccattttggaaaaatttaaatctgcttaattcccctttatttcaacagtgagttgtgattttcctgggcctgggtagagtaggtgagaccaggtgaggaaccaggattcggccaatagcaaagcttgggaaggtatgcagataccctgagtcctgatagaataaaaccaagagcagaatgtggatggtaaatgaattgtcaagatgcaaagcctaagtatataacaagagtattctagaattccaaacttggcaatagacacaataagaaacattaatgcaagtatacagctatgaaaagtccacacacaacagaaaagtcataggcagaagtgatgttcaagagttcagatgtataggagttctgaggtttccacctcaaagtttaagccagttttggaaaaatagattgagaagaacacggagcttgggaaaccagtattgcaaagaggtccatacaataaagtagactgtcggatgtgagggcgatttggctgtgacatctgttaccccactgatcgccagggttggttcagctgatctggctccatgggtgtccctcctgaagctcacactcgcctgaagaggaccaacatccccagtagaggaggaccagtcttcaggcaagggtatatgagtagccgagcttccctgctagaacctccaaacaagctctcaatagagtgtcattgcagagcaatttcatctggtctagtttttagtactctttctggattactggctgaggattaagaaacatggaccagatgaagtcaattaagtccaaaggcaagaaaatataggaactgttgattacagtggagaatggtttctttgatgagctttcacctacatccccttcccactcaaatgactttctgttgcctatgttccaccattaagtttgacaacccactgagggattagactgataatttaatgaaagtcttttagagttctaagactgtaccaattgaatatgtaatatcttatttgctctttatcttacctgtattcataaaagttaatctcaaagaacaactactttgttctaggccttaaaatagtcattagtgagaaactggtaaacatgtaataaatccttctattgaaaaagaatagcaaaactgtaagtttccatttcagattctaaatatctatttttcttgactctgcatgctactaaatcacaatatctaaggcacagtaccattaaaaaaagtatcatatctcaaataagcttgtatatatttaaaacaccgcattatcactgtgctaaatgagataagatcttttttttttccgtatctctggttagaagtaggcagaatcttctgtgaattccagagaacattacacaataccagataccatgagcatgctccaaagccaagtgggaatgatgtctggaatttagggtcctgccagttttgcacatcttgaagcaatatggttcacagcaacgtagaggttagctgtcacaattctcaagtgccaattcagtatgcaaacgaatattgttttcacacatactccattctgtccccagtgtctgaatagagcccttatgtatgctgggcatattgtcaatgtgtattcctatgtttcagacattgcttgtaaggtaggaatacatgtattttaatataatagtattcctgattttttaaaataatttatatgctcatttgttacaagggtatgaaataatactaagattaagcaaaagaattaaggtaaaggagaatcaattagaagagtaagataaagctaggaatgagtgcggcacagaatgcaaacccctggagcccagtactctgaaagttctgaggagggccacaaacttggctttggattttctgaaagctcatgagcatacaagagcataatcagttgcattactggtagtattcataaaataaaaacaaacagtaacccagattaggtcaactattccttgtactgagtcaggagggacaatttgcccttaagtcctcacagacatcacactgcataatgcagtaagccatgttcctgataatatccccacaagaatcacagtcacaagactaagagcccatctctctccacttgggcccattccaatcttttctccattctctactcaatactatcattctaagctaaaacctaatgatgttgccctgattcttaaattctgtaagtggttttccattgcttttggaaacccaaaatccataaggttacatataaggctccatatgttccagtcctgtatgcctctccaaactgcattagaatggactcctcagttgaagttgtgtttctttttcatggactctcagagaaccaggtatctttgctccagaatagtcatttaagttcataattctacattcactggtgtgattacttaagtaatgtctgcttctataccattagctccaggagacttaattccttgtctacttttgtttacagttatttttgccatcaacaagcatatttctgactcaataaaaacgtgaatgaatcaatagatgaataaaaaaatgcaagaagtgaattttttattctttaaaaccaaggaatagtatcaaataaaagtgcagtttggtgtggggagttacaattaaaggcaattcaaacacatcattctatgatttcctaccttgaggatagattttagtactgtcaaaccatcctctggaactattttaatcttgaccaaattttaataagtattgagcaactgggagtttagaatatatttttcacatgtacctattaattatagaatattctattctgacaatcacccattctggataacatccaggactctagattgactcattgagacacatctctatgtaaagccactttgatgtaaatgtcccatctgtaacacggaggtggggtgtgtagagtgaaattaagtttccctgaaaaagaacctatgaggttatgtgtctaaagttatttaagaagataacacatacaggcaataacaagcagtaattattcaaacgacagaagtccacttccagccacattgttgcaattccttttagaagtaggttttatccattgaaaatctcaatttatattaattgaagtatgtgttacagaaatctaatgggaaagttaacattgatactttttcactaactgaaaatttaccccaaaattatagtcccatatttggtttcaaccacaaaaatgccttttcctggaaagcccatcaacttttctcaagtgtttgtgaattattattattataagaaaaaaatgttaacatttgtaacattttgccagtcttggaggcttgagaaaactccaaaaacatttgcaatcattttgagttaatttaaaaagtcaagataaggctcaaaaaaagaagaaagtacttcatgcactgcacacagtagggattcaatgaaagaattctgaggttaattgaatgactgtgtgctgttttttaatgttatattgtagagaaattaaagatatcttaacatatgaagtgtaatagagttagcaaaatgttaataccttacaatggactacataaactcacattagagagagaaatctatctacaaaatgtaacttcattacagattatcaaggtttctgcatgattctataaaacaagaggaaaaattagtattatattatcacaagctttctgatgaaaaatgaggtatagatagagaataaaaagaaaagaaaataagaggcaatagaaaaaatgtttaagatgaatttgacttttgccaagagctaaaaatggagacacacaaacttcctgtgttctttttactgtgtttacatgcaatagagccactttagaaatgtttacctctccagtgtggattttgtaagggaaagaaaaggaagggaagggagggaagggaggaaagaaaagaaagaaaggaaagaaagaaagaaaagagaaagaaagaaagaaagaaagaaagaaagaaagaaagaaagaaagagaaagaaagagaaagaaagaaagaaaaagaaagaaaaagaaagaaagaaagaaagaaagaaagaaagaaagaaagaaagaaagaaagaaaggaagtttcccttgcctgtgttgtcttcttttttactctgtaccttttgtatctgtctctgactatattcctaagaatcgtgatctttctccctcaaactaatagacagtggataggaaaggagatctcaagggtgcccagacagtggatagggaaggagagctcaagggtgcccagagtcctgctctgcaactcaactctgttgcctgtgtgccagaaactgtgcattactcttcttgcaagttaacaagctagcctgttattgtttcatagatgctagcagaaggcatgagactcctgagccagtaacaaaagatttgtattactcaatgcaaaagcatttgtcagagcttcatgctggtttgcactggtttctttctcccctccacctctgccccattctacagaacaatacctaggctcataccttccctaatcaatgatcatccccagctcaagaaacagtcagtgagctgcattccaaaacgggaacgctgtacttttctagtaagaggaggcaagcctgctctatagatggagggagaaattctctcattcctcaaagctgctcattacaaataccaccatgagagatggtccaggtagagagtagccaggaccttgcattccttgcagactcattcagagacactcagggtcaagggagatcatgcacccaacactgtgactaagtcccagtccttctatcaacatggctaagccacccttcaggtcctacctcaggctctgaatccacactgcctgggtgtgaatcccagtatcaccacttattaactgtgtgacatcgtgcaaggtacttaaccactttgtggtttggtttctctgtcaataagtgggatcataataaagccacatcctaggattaaatgagttaatgcatatattgcatttagaacagtgcctgaccatagtaagcgatctttctgtttcagttctaattttgattaccattttccagttatcttttggataacttcatattttctcatttaaattcctcaattggggtttcatgataaaattaaattctaatggccaaagacgtacattgtaagcaatgacttaatttctcatgtatacatctacaatggtactaagcttcataccatccttggaagaactaagaacatagtgacttgaattgctttcactgttctatacttcaaattaggtatcgcagtttaaaaaggcaattattggctggtcgggcacagtggctcacgcctgtaatcccagcactttggaaggctgaggcaggcggatcacctgaggtcagcagttcgagaccagcctggtcaacattgtgaaaccccatctctactaaaaatacaaaaatcagccaggcatggtggtgggtacctgtaatcccagctactcagaggctgagaaaggagaattgcttgaacctgggaggcggaggttgcagtgagccaagactgtgccattgcactatagcctgggtgacaagagtgaaactccatctcaaaaaaaaaaaaaaaaaaagacaattatcttttgccactaatggagagagcatttcacttcgggttatatcatatgtcattggccagccgtggggctcatatcttccctaatcaatgaccatccccagctcaagaaacagtcagtgctatttgccccagcagtctatcttgttcaccaatgtgctgctagggcctagcaccaagtctgataccagtagatacagaaaagtgatttattgaatcaatcaatgaagggtatagcaaggaccatcactgctagcttatccctcctccccaactctatctttacttgggcttgactaattataacatgaatgattttaaaggacagctcatttctctatttggttttggtctgcaaaaagtaaaatagagagcttgggaagttatgtgagaacacacgtgttccctaagataaaaattttataatactctttgctaatttttgcaacatggcaaaattaaggtagtttagacatatctgtaagatcatgagaaatgttctaggtgtattgctttctgatgacaaaaatgagaaaacctaggaaaacacagagttgacagatcctagatgattttcttttaatacattatgtctcaaatagaatttcaggaagtcctggttcgtattcaattcaggtttacatattctgacatgagatccatgtgcttaaatatgaggctgtcagaaggcagaattatatctattgtatgtggtttggcacttgacaaattactggtcctgggagccgtcccacttccatatgaggctgaccacaggctgcttgaaaataaaatattttctcaaaaaggatctttttaaaatatttgaactctggcaaacaacaattgtgagcctcacattctgatttatataaggaataataaattatggcttgaaaaacgttaggacattttgtatcaacaatttttgcagataatatattcaaattcttaagcaaatcaaaacaaagaactcttagcatttgtgagctcagtgctgagctagtgggcatgtggaaagttcagtgtatatgatctgccttcaagaaacttcgaaattctaaattgtgttctcagacatctggctcctgcaatcttttgactagaaagtatacctcttctgaaagaaggtttactttgaatgtatactgtattttaaaaagagagcagcctgtaatctcagcactttgggagaccaaggcaagtggatcacctgaggtcaggagtttgagatgagcctggccaacatggtgaaaccctgtctctactaaaaatacaaaaattagccgggcatgctggtgcgcatctgtagtcccagctacttgggaggctgaggcaggagaatgacttgaacctgggaggcggaggttgcaatgagccgagtttgggccactgcactccagtctgggaaactgagcaagactccatctcaaaaaaaaaaaagagcaaatccagtcagcaagctaactaatcagatgtttcaaaatagccaaataagttgctccttaatgttattttggaattttatttaattcctatgtaatttaattgtacacccaaactatgtttctttcagtacatttctgaaatcagttatgataattttatgattttttttcacaagttaattttaattttccaagtccctataaagtctcgaactgttttggcttgattgtcatcttttaaattactttatatagatacatactgcaaactaaaactgaactgccatatgattgaacttttctcctacctggaaatgccccctgaccaaaaacattgtcctatcagtgtgcttgtatataactaaaaggtccattacataccagtacttaaaaaaaaaatttccatgaacccagggatgaaatgctttctccaaagctctcatgttctaacattaaaggaaaagaaactggactaatttgctattgttcacacagtgctttttttttttttttttttttgagacggagtctcgctctgtcgcccaggctggagtgcagtggcgcgatctcggctcactgcaagctccgcctcccgggttcacgccattctcctgcctcagcctcccaagtagctgggactacaggcgcccgccactacgcctggctaattttttgtatttttagtagagacggggtttcaccgttttagccgggatggtctcgatctcctgacctcgtgatccgcccgcctcggcctcccaaagtgctgggattacaggcgtgagccaccgcgcccggccacagtgcttcttaaaaaagaagaatgtgagcttctaaatgctataggtaggaggccccactacaaagccctctctagatgtggcaaatggaatttccatggcccaactgccttcattcacactgttactaccatagtcacttcctaccagtagaaagatagtgttaccttatttgttgctaaaagttctcataagctcatttatatgcatatttcaattcaacataaaaacacaaacaataaaaacataaagacagcaatctgcattgcactcctaaatctgttcttcttttctagagtgtattaaaaatttgagtgggattaaaatgtaaagattatttatcccattgtctttcaaataaggaaatttaaactaacaaatattgtaacttgcccaagattaaaaccagaaatagattaaaatgcatttgttaaattaataaaaaagcaaggtgatgtgtattcgccagattgttcacttttcctgatatttaaatattgtgaacttcaaagtacatttctttgacacttttcaaaatataatagtttttccaagaggttactaatacattagactatctgacatcctgcctccctcctcctccctccctccctcccttcttccaacaatgagctgtgaaaatatcgcaggcactgcatttgtcactagaaattaaccaaaaaaggcagggggtaagaaatattttgggcctcaaaaagagagcaggcagatatccaaagtgctaagattttctgcactaaaaggtaaagttgcaattaattttctctatcacacaaattttataggttcttcgattcaaaaggaaattatacatcaaggtaggttctttccttttactatatatggtagttggtttttactgcaaaaaaattaatatgaaagtagaagagtaatggaaaacactttatagctgactttgcacagccattatatcacaatttgattaatgcacctagttaacatttaactgtcttaagagaaatatttttcttgtttacagcacacattttttccttccccaagcttaatttaatgggaaaactcccactgatataattgttaatgcttgagaatttttgtttctgttcacaaagcatgatatacatttttatgtgccatgtactatatgtgttgaagcagcaataacatttctcatagccttgcaaaaataaaacctaaactactgtggtgatttcaacagcaaaaaatcctagatttaattaatagcaaagagctactcttccaaagattaagtgaagatttttatttaaatccaactcagcaaagaaaattgggttcttaattgttattcggtatctgtcttgtagattcaaaatgacttcattttattatctggtagcaaaattttactaaaagcaattttctgattgacttgcattctgacatatgaatcattaaaaaataaaagttaattaatcagactttattgtaaccagcactctgcacattgcaatctctaacagcaacatctatgtgtgaagatggttcctgcagactattctaaataggttatctggattcagcttggagttaaatatgcataaggagcacactacttaatcagaaataaagatttctttttgtaattaaaacaaagatttagaatggatgaaaatgttcttcacaaactcaaatttatgaattataattgccccaaaaaggatttatttctcgagacatagctgcagactttatcgtcctaggaacactgtcaattcattttaaaaattcacacctgctatcaactgaaattaactcatatttactaagtacctttttatataaggttttctttttgtcctcagaagatacaacctgaattaatgttaatatatgttcttggtaggatgcataggtttctgcagatatgtatttcaaagtttcatcaaacatttttttcctttgttcccaagttttttatttagaatatatctcagaaaaatgaaattatagttgagaatgaattgatattatttccatggggataagacaattacatagcacatctgaatcactaagtccttaaattttttatttagaatgaggtgatacattagccaattgataatatatataactttgatctatatgtttacattagataaaatatattcgcaaattgagttaagtgacaaatgtaattgctaccatttacaataaagtagacatgttagatatcttccttatctaattttatttctaacttcatagttaaaatttgtgagcccttccttatctaattttatttctaacttcatagttaaaatttgtgagccagaaagtggagacaccaaggttaatgattaatctctccagtactaaactaattctgttgttaacagggtgaacttggaaacatcctagtaggaaacaccactgcttgtgaaaggaagaacagacctgagtaaacatgtggagatgaaagtgtgtttttttgctttcttagaggtgaatccataagctccacaagcccttgtgtagcttgtcgaaggcttttcagagtatgccacaaccaagttgctgagtgctgagtaattacagggagtgcaatataaccatgtaaggaagatgctggaaggcatcgtggacacagagaagcatttcctggctgggagtggtggggtgcgagagtcaggagtgaggctgaaattagcattattaactcaaagttggatgactggtgattagggagtaggttaaaaagccagttttattgttaaggatgatctctaaagatggacactgagatactcgaggaggaaagaaaagagcttctatcggaggattgtgagccctttcaaattattaggccgagagacattaaactgagacagcagtcacatcctactccccactgtcagctatgtattcatctattgaaactgcttgccattgccacagatagagatgcattaacctaataatgctcccgggacactatgtcccacaccccatagcttaacaatgcatagccaatcaagaatcagtgtgatttcttcaaaccaatgagcattcctgacagaactttgtatcagctaactccctatccctttattagaattaaaaacctgcctataataaaagccaaatagagctcacatccaaggttacttggggctgagttttccaggcagctgtcctcactttggctcaagtaaactctttaaatcacattttgtgcttcaggctcttccttttaggtcaacatttattacctgagtagtgtactctaagaactcccagctcaagtgagtaattttaacatgtcccacgtggtcgtcccgctatctggagtgaggcttttcctgcctcccaccgtctcaggccgaagcttccctttcattaggagacagaagatgtctggagtcctgaatctttataagtagtctgttgtgcaatgtgtgaaaaggaccgctgggtaaagtcttgctggatacaaaagagcatcagtctagctggaaagattaatgaactgcctcctgccaatgtgtccggaattggtgggttcttggtctcactgacttcaagaatgaagccgcggaccctcgtggtgagtgttacagctcttaaggtggcgcgtctgcagtttgttccttctgatgtgttcggagtttcttccttctggtgggttcgtggtctcactggctcaggagtgaagctgcagaccttcgcggtgagtgttacagcgcttaaggtggcgcgtctggagttgttcattcctgccggtgggctcgtggtctcgctggcttcaggagtgaagctgcagactttcgcagtgagtgttacagctcataaaaacagtgtggaccaaccagtgagcagtcgtaagatttattgcaaagaccgagagaacaaagcttccacagtgtggaaggggaccctagcgggttgccgctgctggctggggcagcctgcttttagtctcttatctggccccacccacatcctgctgattggtagagccgagtggtctgttttgacagggcgctgattggtgcgtttacaatccctgagctagacacaaaggttctccacgtccccaccagattagctagatacacagtgtggacataaaggttctccaaggccccaccagagtagctagatacagagtgtccattggtgcattcgcaaaccctgagctagacacagggtgctgactggtgtgtttacaaaccttgagctagatacagagtgccaactggtgtatttacaatccttgagctagacataaaggttctccaaggccccaccagactcagtagcccagctggcttcacccggtggatcccgcacctgggctgcaggtggagctgcctgccagtcccgccgcatgcgcctgcactcctcagcccttgggtggttgatgggactgggcgcagtggagcagggggtggcgctcgtcgaggaggctcgggccgcacaggagcccacggagggggtgggaggctcaggcatggcgggctgcaggtcccgagccctgccccgcgggaaggcagctaaggcccggtgagaaatcgagcgcagcgcctgtaggctggcactgttgggggacccggtacaccctccgcagccgctggcccgggtgctaagcccctcattgccctgggcgacagggccggccggctgctccgagtgcgggcccgccaagcccacgcccacccggaactccagctggcccgcaagcgccgtgcgcagccccggttcccgctcgcgcctctcccccgacacctccctgcaagctgagggagccggctccggccttggccagcccagaacggggctcccacagtgcagcggtgggctgaagggctcctcaagtgccgccaaagtgggagcccaggcagaggaggtgcggagagcgagcgagggctgtgaggactgccggcacgctgtcacctctcaccaacaagtggccttcaagtgataacgaaaaggactattctgtggcgctacctcagcctccagcatctccggggcacaggtgatggatactcctgagttcagagaagctctagctccacaactcaaagctcctgtccacaccggcattccgctgtgctctctcccctgtgccctgatgtagaagatcctttcttctaagttccctttgcattataattgagtacttattaaaaaggcaaatttggcccggtgcggtggctcacgcctgtaatcccagcactttgggaggctgaggaggttagatcacttgaggccaggagtttgagaccaggctggccaagatggcaaaacactgtctctactaaacatacaaaaaattagccaggcgtggtggtatgcacctgtaatcccagttactcgggaggctgaggcacaagaattgcttgagcctgggagacacaggttgcagtgagccaagattgcaccactgcactccagcctgagtgactgggcccgattcagtctcaaaaaaaaaaaaaaaaaaaaaaagcaaatttcgcaggcctaaataaattggtttctctggagacttgcattttttgaaaatccctcgttatttttatgcatgcttaatttggagaaccaaggtaataaaaaatatagagagtatttacaatggatatccatccatttttgaatatccatcaagtattggggagaaaaaaattaaatatgaggatttaagtaataatccttccaaaaggttatatttagttaaacacacgacttgacgaattatttttgttagaagttcacaattcattcctatggttagtctgttttttaaaaatacactcttctaagtgtctccatcatcctcacctgaattcttcttaaacacacaaatcattgggttcctatatctttgattcagtagacctggagtgtaacgaagaaatctgcatttcaacaagctccccggtttaataccttaaatctctagaaagtttgcaaatctcttgttaaaggagagagaacttcatgtgagttctatttcatcctaactattggcttcctgtcagaactatttgcgttgtttcttcatctgtaaattagcttaataatatctcttaaactgttattatgaagatttaaatgcaggtacagtatagagggatacttagcagacaataaagagctaaaataatattaaattgttgatagaacaaagttcatgaaagatgagtgtgtaaccaagaaatgaaagcgaggatccggaggctggctctgttctttgtcatgctcggtgaccaagtgggaagaccgtgtcctctgatgccgatctttgtgtacgcctgaattacacatcatgacacaaacagaaagttacacaactcaatttcctttttagctttctaatgtgaggtgctcgctctatctccctttctgtctgcctcactccattggttaatgttttaaattctttgttataacctgaaacagtgatgaagtgcacaggatacaaggaaagcaaatacttctaaagggtgttttttgcttggcaaatcaaacaggagattttccctagagtattctaagttaggtgaaactgagggtgcatactccataaaatcctaggagttggtaagaaagaaagtacagagaaatatcttctttattttgtccccaacttgcagtgtaaatggattctatttgtattgtattctattattttcttttaattcctgaaataaactctataatttggtatttattttagcattttaaattatatgttcttatgctttatgtacctctggatattgtcataaatcatttttgtaactaggcggaaaatcaatctgttgtctgcctgaaggagaagtgaacattgctctttaatatttggagtttttaaaaatcatatttctttatttatattaatcagacgaatcctctttgagcttcgtctgcctagccagcaaaagttcaaccttgggactgggcacagtgactcatgcctgtaatcccagcactttgagaggccaaggtaggtggatcatttgaggtcagcagttcaagaccagcctggccaatatggcaaagccccatctctaataaaaatacaaaaaattagccaggtgtagtggctgaggcaggagaatcacttgaacctgagaggcgatggttgcagtgagccaagatcatgccaccacactccagcctgggtggcagagtgagactccatctcaaaaaaaaataatcatcatcatcatggttttggatgtagagcagggagcggaggaatatactcggtagccatatccaactacaggtccaacaaagagtctcaggattttagacaatctggaacatttcagaaagaaccctctgaatttaagatcacattggtctgttggtaactaaattgataattatctaaccagcaaggtcaaggtcattagcattgctttttgcaggccaaatatggacataggaatttattcagagggtacatactccatgcctggctttcagtcttcctaggctcatttctatttgagttctaccttatccccaggacactagaagagagtagggcacttgcatcctctacttgaacactacaaagctttctgcgttcttaacaacttcaggaatttccctcgcttgccctcctctttagttaagtctacttccttaatctatgcatgagcattcactctctccatcactggcactgtgaatgacacctcactttcagagactggtatttgtttcctggaatgagtagggaaagcagtggttaagaacatagggtaatttttttccttaacagttatatttttacataatctagttctgtacttgtaaggtaggtcagctagcaacaaattatctgagtttttgtttatttgcttgttttattgataatgtctttattttgtcttcagttttgaaagataatattgctggttatagatatccttggttgactttcagccctatgaatatgttatccaactgtctctggccttcgttgtttctgatgaaaagtcagtagtcaatcttattggaattcccttgaaaatggtgagtctttttcttgcaggtttcaagatttttctctttgccttgccatcaacatattaattgtgatgtgtcttggtgttaatctctttctgtgtatcatatttggagttcactgagcttcctgtatttgcaaacgtttttcatcaatttggagatgtttccagctatgatttcttcaaatgatttttctgccttgcctctctttttttctttcttcttcttctagttttctcagtatgcttttattggtacacttaattatgtcccacatttgtctgaggctcagtttatttttcttcattgttttttctctgttgttcagactgccaaatctctgttgattcattttcatgctcacttatttcatcttctgcccatttaacttgtttattatacatctaaactccagaattttcatttggttcttttttatctctttttgttgatattctctatttgattagtcattgccaacatgtttcctttagttctgtagacttagtatcctctagttctctgagtaaatgtacaatggctgttttgaaatgtttgcctgctaagtccaacatcttgggcccttcaaaaagcagcttctattgcatgatgtttttctctcctttttttatgcatcacacttcctttttatttgcatatctgataatattttgttgaaaatgggacattatatataatgcaacatctgtagaattgattcctccatcctgggaagctgatgttattattcacttgtgaattcatttgctaaagaggtttttttttaatttttaatttttgtgggtacgtagtaggtgtatacatttatcgggtacatgaaatgttttgatacaggcatacattgtgaaataaacacatcatagagaatggggtatccattcccccaagcatttatcctttgagttacaatcaaattacattctttaagttattttaaaatgtactattgttaactataattaccctgttgtgctatcaaatagtaggtcttattcattcattctatttttttgtacccattaactatctctacctcccctgcagccatgactacccttcccagcctctggtaaccatccttctactctccatgtccatgagtacagttgttttaatttttagatgccacaaatgagtgagaacatgcagtgtttgtcttctttctgtgcctggcttatttcacttagcataatgatctccaggtctatcatgttgttgaaaatgactggatctcattactttttatggctgaatagtactccattgtgtatatatgtcacattttctttatccattaacctgttgctggactcttagattgcttccaaatcttagctattgtaaacagtgctgcaataaacaaaggagtgcagatatatcttcaatatactgatttactttcttgtgtctatatacccatcagtgggattgctggatcatatggtggcttagcttttagtttttttgaggaacctccaaactgtcctccatagtgcttgtactaatttgcattcccaccaacagtgtacaaaggttcccttttctccatatccttgccagcatttgttattgcctgtcttttggataaaagccattttaactggggtgagataatatctaactgtagtttttatttgcatttctctggtgaccaatgatgttgaacaccttttcatatgcctgttttccatgtatatgtcttcctttgagaaatgtctattcagatcttttgcctgtattttgaaaacattattagtttgctttttttttcctatagagttgtttgagccccttatatagtctggttattaatcccttgtcagatgggtagtttgcaaatattctcccattctgtgggttgtctctttattttgttgattgcattcttttctctgcagaagctttttaacttgatgtgataccatttcttcatttttgctttggggtattactcaagaaatttttgcacagactaatgtcctggagattttccccagtgttttcttgtagtagtttcatagtgtgaagtgttagatttcagtctttcatccatttttattttattttttatatggtgagagataggggtctagtttcattattctgcatatggatgtccagttttcccaggactatttatagaaaagactgtctttttcccagtgtatgttcttggcacctttgtcaaaaatgagttcactgtaggtgtgtagatttgtttctgggttctctattctattccattgttctatgtgtctactttaatcaagcaccatcctgttttggttactatacctctgcaatataatttaaagtcaggtaatgtaattcattcagttttgttctttttgcttaggatagctttggctatcctgcatcttttgaggttacatataaattttagagatttttttgtatttctgtgaagaatgtcattggtattttaacagggattgcattgaatctgtagattgtttggggtagtatggatattttaacaatattaattcttccagtccataaacatgaaataattttcacctcctgtattagtcagagttcttttagagggacagaaagaataggatatatataaaggggaatttattaagtattaattcacataatcacaaggtcccacaataggctatctgtaggctgaggagcaaggagagccagtccaagtcccagaactgaagaacttggaatctgatgttcaaggacaggaagcatccagcacaggagaaagatgtaggctgggaggctaggcctctctctccttttcatgtttttctgcctgctttatatgtgatggaagctgatcatattgtgcccaccagattaagggtggatctgcctttcccagcccactgactcaaacgttaatgtcttggcaatacctacacagacacacccaggattaatactttgtatccctcaatccaatcaagttgacactcactattaaccatcatgcctcccatcaggtcccacctccaacattgagggtaacatttcaatatgagatttgggctgggacacgcatccaaactatatcaggtgtatggcttagaagctgctatgataggtcatgaagtttatatttttgccttatgttcaaccaggaaccggtagcttggctttccctgctccagcactcttgagagggtgcagcaatggacatgcatatggtcttctgcactgccagggaagcatgtgatttcatctttaatccttacttcctataatttgccgctgggtcagaggactttatggttcaatcagtggttgctcagtttagatccttagtgccagtacagtgtcagtcctattctaggaatatccctagcaaatatatgaagatgtctaaacaaaggtagatgatttgtcccagtatctgagaggtgtaaaagatgaatgcacttgcacagatacctggatctggtcatggatggtagatgagattgggagttacagttctgataaagctgccacagcataggatgtatattactcagctttctccagagaaacagaatcaaaaggatgtgtgaagacaatagatagatagatagatagatagatagatagatagatagatagatagatgataggaattcattataaggaattggcttatgtgattgtggggttgaccagtcccaagctctgcagggtgagttagcaagctgtggacctggagagctgatagcgtagttccattctgaagaccagcatgctcaacacccaggaagggtcaatgttacagttcaagattgaaggcaggaaaagtctgatgttccagttcaagagaagtcaggcagaaagaattcttactcagaggagagtaagcttttttgttgtgttcaggctttcaactgattgattgaggccccccgctccattaggtagggcaatccgctttattcagtctaccaatttaagtgctaatctcatccaaaaactcccttatggaagcacccagtatgacctttgcccaaatgtcttggtaccctatggctcagtaaaaaatgacacataacattaagcatcacaggaaggaaagaaacaattccagcagaaggatgcttatgaatgtcatcagcgggtcaggtagaagtggcaagcaaatcttacatgcaaacaccaacacctaggggagctatacaaaagtgcacttttcattaatgtgatcctcagtatgatgtccatgttcaaggaatgtaaaagtaataacagccaaccaataagacaattataacttcagcaagttaagtaaagaggtattaatgtttgcccttttcctttgttttcccccactcaaaaacacaagaggagatagcacacagtaagaatgggaaaacaatgagcaaaattcaggccataatagctctggttttgagatgttagaaaggctgtagagagttagaaagagtcaattggggtcaattgactcttctatctgtctctttgaattttacatttggcagtagctttaggccaataaactcaacttgcttcacaccaaactatgcatgtggtgcttggttaatgccacacttaccaccaggaacttgaagggaatccaggcccagtaccccaatctctcctcctccaatgtacaattgcctagaatatttaactccatatatatttaacttttccgatttgtgtatcacacttttgttttggaaaattggcaaccaacaggaatgcaacctcttaactgggagcaagaagttctgccttttacttctagttatattgcttgggaaaaaagctgtttaaccttcttggcctcgtaatcctcatctttaaagattaagatttgtctaggtcaattattcttaaattttgtgagtcatgaactactggaaaaatcatttaagcttttatcattatgttctcagaaagctgtagaccttcacacaaaaattatgctgagacatacaaattggataatattttgcatattagataagttatggactcttggaagatggtccagattaagagtcttcaaacaatctgctagttttttcttgtctccagttttttacaaaatgtttaacttttgaatcaatcaaatagttttcttggagaaagttttccatataatgtacaaattgaataacaggcataggataaaagagtatgaagaagatgattggcattaatcttgagttttgaggttttcatagtttaagaattattgtaaaataaaaattgtttccaaggatcttgtagatcagcagctggtgaatataaataggatagagaaaatgttttctgctttgcaggccatacagtctctgctctgactactcagctctgccaccatatcatgaaagcaaccacagaaaatatgtaaataaatgagcatggctgtattccagtaaaactttatttacaaaaacaattagcagatgggttttaacccatagattgctagtctgttttagatgaccaaagttatctttaaacttttcatttaattttgcctaatatgcttaacattttgccctaaaattgaagcataacaacatttatagactaatttattttttgtcctaacattgaggtggaacaatatctgtaatctaaattcattatcttcattatacaagtttatattcaggaaaacatgtacaaagtatttttcatgtaaaatatactgtgccttttagatatgtgaatgctatagatctcaagaatttagtaatcctaaactctgtactattaccctctaatttattccattctcagcttcataaaagtacattatgaactttgcttgaaaaactttgttttgaagcaaagttatccatttccatggataaaagacttataaattgaatcaaaattgtaaatacacagtatcaaaaatcttgccaattgtcactatatctgcattggagctaatcgcatcaatccaagaagttatttattctgtatttgtgccttattttaataaagttatttattcataaatctctccattgtgtatacaagtttaattttcataattctccctttaaggaccattccatttttctgagagtaaagattaataaaaacaaattaaattattttgattttcagaggaaatcagattttgaactccaaagtggtacatgagaaacccacaagattcattttcaaggcttatgagttgatatcctttttatatagtacctttacaacatcaattaattacttttttttcattcttcctttgagataaagattttgtatgataattgaaattcaggtcaagttatggccaaggaaagcttaatccttctttgtcttttatgtagtcctttgtggtagccatttaaataatatcttatgtaaggtgacttggatgagaaaaaatactttaggctcacagaaattttatattccagatataaatttctttttttccagatctcacaaatctgctgagatgtttctactaattcttttttctttttctccttcaagaatttaaactgttacttctctggatgttccttcaaagccttaaattttgcaataaatcatctctctccctttttgtctccactttctatttttttctctttttgttgcattttacacttccattggtctctgcaatattgattagaaataagaagtaaacaaaaactaatacaacttctggagaaatgtattggtctgcagtctgacttttctgtttgctttattatctcttttgtaaataatcctaatatttcttccttccttttagattgagctaagtcaatttttaaaaatttttccagtctgttaaagctcattactagatttttgaaattagcattttttatatattctactagaaagtatttcttattgactatgtgatctgtctgtttcaaatgcagataacctgacatttgtctttatcccagtagaactattcatatctagacagccaaggtacaatcaatgacaaggtcctcacagatttagggtacgtttttaatattaaatatgatttgacctctcttaatcatgacagtggcacaggcatctttaacactctaattgttcaaaagaactggcacaccaagtcataccagattttattccactttatccttgttcttttagaagagcttctctactagctgggcatggtggctcatgcctgcaatcccagcactttgggaagctgaggcaggtggtctaggtcccatcgttcaaagcacagaaagccaattaccaagacaacaaggattgccaaggaagaaggctttttatttagctgacatcagccagggagatggaagccaaacataaaatccgtcttccccaacctactaaaattgggggcttagatagtgcaaaaggaatgtagctacatgtgggaaggaattgggggtggggttaaggaagaaattgtgactgatgaggggtctggcatctcattgtctggatgaggtgatctgatgagtttcacttccttactgggtggggtagtttcctgaaaacagaacttagataaggcaaatgtaactttaaagttataagaccaaggaggtccttgagcccaggagttcaagcctgcagcgacctatgatcaagcctgggcaacacagcaagaccctgtctctaaaaagaatttaaaaagaacagggagggtcattttctatgtttattcaaaaagctgtaaatattagttctaagggacagttaggcttttcactttctccattttacagataacattgctgaagccaagtgtttaagtaattttcccaaagtcagtacacagaggatctatgattcaagccctcataggtctgcctttaatatatcatgttgtttctaatatagcatgtatctgtcttcttaaggagaaatatattgcctctatataaccatttaggagaaaggtctaaatacctttcttaaacacaaattttggggggctttaaaataaatattgctatttttgtctttttcacaattttcccacctctccctacccccataaaaagccaacacaaataaacttacagctttgagatgtatttattttttaatctaagaagtacttattgagcacctatctgtaaaagatgctatagaagatgttgagaaaatataaaatacagtctctgacttgaaaacattgttttcatttgctacatcctccctcattaactggccattttctcatctttaaaacaagcaaaatcatagtacctacttcatttactttttctgaagattaaagaaaatgaccatttaatgaggttatcccagtgcctggtaattgcatgattaacaaatcatgcaaaaattactagttcatcataactactaagcaaccgtaattccttaagtagccttcatatgacttgatttcaagttgtttactattctagttgtagacatttcctttctaattgtctatgtttttagtgaagtatatcaatcagaaaaattttaataatatacatttggtttgtcctaccaaaggtagatagttgttttcaaacttaaagttgcaaagtgcataaagattactctggagcttgttaaaattgcaaataattataaaaatctttctagagtttctgaagcaataggtacatggtgtggagtgcagtaatctgcatgtttatgaacatgtcctgagaactgcacttcgaaaaatgctcaatctgggtgtggcggctcacatctgtaatcccaacactttgggagaccaagacaggaggatcacttcagctcaagagttcaagaccaacctgtacaatagggaaaaaccttgtctctacaaaaaataccaaaattagttgggcatggtggtgcatgcctgtggtcccagctacttgggaggctgaggtgggagaatcacttgagcccaggaggttgaggcttcggtgagccaagatcataacactgcactctggcctgggcaacaaagtgagaccctgtctcaaaaaaaaagaaaaaagaaaagaaaaaaggaaaagaaatgaaaaagacttaataaaactatcatctctcttgtttaggtgttttaccttctcttaatgcagcttagagaacatcagaagttttgaaagtcagatcatcctgatggctgcttgcatttactgtaagtaaaaacaccagaatgttctccttagcagaatataggtagctttcttttttttttttaattaaaaaaaaaaaagggtgtcactctgtcacccaggctggagtgcagtggtacaatcatagctcactgcagcctcaatctcccggactgaagtgatcctcccacctcagcctcccgagtagctgggactacaggtgtgtgccaccatgcctggctaattttttttatttttcatagagacagggtttcctatgttgtgcaggctgatcttgaattcctgggctcaagaaatcctcctgcctaagcctcccaaagtgctgggattacaggtgtgaaccaccacacctgccattaaattttttaatttttaatttttcccccatctcttaaaactatcacaagggtagccttcttcatccaggtctttcattgtcctagtttggagaagaaggacatattccccaagtggagggcactttcaggacacatgagatcttaacagcctgaggagatgaacaatctaaacaaaactaagaaacaagtcaagacaagagacttctggtttagcgcaggtctatttgtaagcctgtttttcatctcctagcttaatggctgagctttgtcaaggttccgtttggtctctattcatttaatctgtgcttttaattaaattaattgattaaaaacatttaatccacccatcttatcagatagttattattgttctcccccattttaatgatgaggaaactaaggtacagaaaggtgaagtgactttaccaaggtcacacagctaataaataatggaactaggccgggcacagtggctcacgcctgtaatcccagcactttgggaagctgaagcgagcagatcacgaggtcaggagtttgagaccagcctggccaacatggtgaaaccccgtctctactaaaaatacaaaaattagctgggcgtggtggcaggcacctgtaatcccagctactctggaggctgatgcaggagaattccttgaaaccagaattcagaggttgcagtgagctgagatggcacctctgcactccagcctgggcaacaagagcaaaactctgtctcaaaaaaataaaaataaaaaataatggaactagtatttgaacccgggcagtctggcttcaatgtgtatgttcacaactgctgtgtcatattgcctgcctgaggatcaatagatgccacactgaaaaatgacaaatgtgacacttctttcagtttaaatacagatggggtatgagctctccttttcctctttggtaaaccttagagttttaggtgccatgcttagataaacttatatgttagtttaaaaaaaatacacacatacaatgaactagacaatggtcttttgctttaactaggcttaaaatgaaataaaattatcctcttttttaaaaaaattacagaggccgcaatacataacgctgatcttacagagctgttttgagaatcaaattagataatttatatgaaagctcctataatggttttagcatagaatagatgcttaataaattgtatttgctttatttttgaaattgcagatgttttgctataataccctgttaggaaagagctgcttacatttaagaatgagggagaaaatcagctttttactctaaagttggttggtaaacatcattacaactaaaagcctgcgttggtataatagtgtaagcctctcatttgttgctctgcctgcatccccatcacagtgcctgggtcatagaatttgaccaagtataagtgactaagcatagtatttgtgataccaaacaaaattacaaattaattaacattttataacaatcggttacaaaagctgaaaagaaagttcaaacaaaaaaggagaagaaaggtatacacctattgaattcctaatgtgtgctataaaatataccaggcgttttctcaaatgtaatttcatttatgctttatataacaactcttataaatgttgttagtgagcactaacttgagctttttctaggattcagaaatgaggaaaaccgcattgtcccttacagataaagtatgaaccaccacataaagactgacagcagaacactcacaatcatctatttgacgtctaggactgaaccaatgcaaagagagggtgtgggaatgagccgcagtgttgggcagacccaaagagtacagtaataacttctaccgatcgggcacttgccctattgctctatgccaagcagtgtactaagcacttttctttatttttctgacactgtgagacagagatagatttggagcccgactataggcctgtctgactttgatgtctatactactgggatcacaaaagcaaatgtcaccagttcctgacctgccagtgtctggtagaactcttttgacaataaagagttctaatgaacatttgtcacttttttttcttcaaacctttattttaagttcaggggtatatgtgcaggtttgttacattggtaaattgtgtgtcttgaagatttggtgtgcagattatttcatcacccaggtaataatcatagtacccgatacgtagtttttctatactcattctcctaccaccctccaccctgaagtaggccttagtctactgcatgacaacatgtggtatttgattttcagtccctgcattagtttgcttagaataatggcctccagctgcatccatgttactacaaaagacatgaccacattccttttcatggctgtgtaatattccatggtgtgtatataccatattttctttatccagtccactgttgatgggcatttcagttaattccatgtctctgctaccgtgaatagtgctgcaataacacacacatgcatatatctttatggtagaatgatttctagtcttttgggtatatacccaataataggattgttgggtcaaatgataattctgttttaagttctttgagaaatctccaaactgttttccacagtggctgaatgagtttacattcccctagcagtgtgtaagcattcccttttctctgcaaccttgccagcatctgttattttttgactttttaataacggcccttctgactgatgtgagatgatatcccattgtgatttggatttgcatttctctaatgattagtaatgttgaacattttttagatgcttattggcagcatgtatgtcttcttttgagaagtgtctgtttgtgtcttttgcccatttttaatagggttgttttttgcttgttgatttgtttaagttccttatagattctggatattagatctttgtcagatgcatgattttcaaaaaatttttcccattctgtaggttatctgtttatgtttaccgtgttgatagtttcttttgctgtgcagaaattctttaattaggtcccatttgtcaattgtttttgttataattgccttttggttcttcattatgaaatatttgtcagaacttatgtccaaaatggtatttcttaggttttctcctagagtttttatagtttcaggttttacatttaagtctttaatctatcttgagttgctttttgtatatggtgaaaggaagaagaccagtttcaatcttctacataaggctagccaattatcccagctcgatttattgagtgaatcttttccccattgcttgttattgtgaactttatcaatgatgagatgattgtaggtgtgtggctttatttatgggctctctattctgttccattggtctaatgtgtctgttttattacaagtaccatgctgttttggttactgtagacttgtggtatagtttgaaatcaggtactgtgatgcctctggctttgttctttttgcttaggattgctttggctatttgggctctcttttgattacatatgaattttaaaatagctttttctaattctgtgataaattttctggttagtttgataggaaaagcattaaatctgtacattgttttaggtagtattttaacaatattgattcttcctatccataagcatggaatgttattccatttgttggtgttgtctctgatttctttcagaagcgttttgtaattctccttgtagagatctttcaccttcgtggttagctgtattcctcggtattttattcttttcgtggctattgtaaatgggattgcattctggattgggtctcaatttggatgctgttggtatatagaaatactactaatttttatacattgattttgtatcctgagactgtgctgaagttgtttatgagatctaggaactgaggtgtttccagtcttcttgccacaacagtctaatggagaatgctgggaaaagcacttcatcagggtggcggcagcaagatctgaactcattcacatgtgccatcaatagtagcagcacaacccatttgacacattttttttttggctacttaatatttatctttttccatgattggatagctacataatatgtgtcttcgtagaaggccaagccaatttgatactcatcagacctggaattcagagttaaggatgctgagaagcagaggctacatagctgctacatcccatctagtttttagttaccacactgtgggcagtgcactggtagctctagagacccaggccaactttcgctacaggaagcaatattctgttcaccacgttccctagcacagctctgacacagcctcgcgttattcctcttcactttctgctcctggctcccccaaacttctcatgatcccatgagtcagctaacagcctttcaattagttatttttctgcttacatgagaacactgactgacacaaacatcatagtcaacctacatagtcaaaggagtctctctggggataggtgaatggagctgtcttagcctcatccatctaaaacttcatcatacaactctatctcttgcttatccccaggaaaattttaaatcatgatttggtttcagtcctttgaaaaagagtaagtcagtcatgccaacatgaaaattcccattcaccagaatgactctgcttctcaagttaatgcatctgacttctggctttctgacatcagtgtcaggagtttcgttgatgtgaatctacttttgaaaactagattcaaccttatgtgctaacaactcatgtgactgagggtcagaaaaaagggatgttggtaaattcccaaattcactaccatttgggaaaaaactggctgtctttcaacaattattagctcagccttgccttcaaacttttccttcatgtaggtgaatagaaacagagtaagtagaaaaaacatctggtaatgtaactgtcaagcaacaacaatgggaagtttcagaatccatcatttgcctatgacctaactgtcagaaatttgcaaagtcattaataatatgagaaaattccaagatcaatacttaatttaaaatgcaagagagcagataagatgataaagtaatctttaaattccatctgaaggtgcaggaaaatggttagaacagaggaggactctccaggtggattgcaaggcaagggggatctgaggggagatgctcagagacagagatcaacccaaggttctcaaagagccatgcatgaagagagaaaagaactccagctcacaggagtaaataagggaggtaatacagggaaaatatcataaacttttatcagtccccaaaaatgtgttatataggtgcacaaaatccactgagagccagtggacagctgagacagaaaccgtgcatcaggaaatcctggcaatgagaggaccaagtttggagctttgggacaaaactattgggcaatgaggttttaagcaaatggaagagaaggcgagtttgtagcttccatcagtctcaatcacactgtgtaaaatttgaggctgcttcatatcatgcatagtcccaacgcctcaaatccctcttgaaagcatgatttaatatctaccaggaatttttgttcaaatttattgaaaatatgtgacatttggactacttctgtttaaatagtcttgaaatttggggtacagtaaaaacctcagtttgttcaacttccagtgcaaccaatcacactgagaatgtaaagtctcaggccctcaaataagatttcatatatccagctgtctgactgtaaatgccaattaaaaatcattttgtagcttctcttttgtccatgttaaaaagatatcaaggacttaattttttacctgcatttctgataacaaattagttattctaacccatctcagaatctgacaaattcttaggttcagtgcaaaatttctcttgcctattgtgtttcgttatttgaaacaacctaccaagacagaccagtattttatatcaatggctttaaaaagcacatgacaatgtgcttatatagcattgtcacacaattttaagacatcatctatctttaagaatcattcttctaaatctgcactgatgctctcaggtcattgtaaaacatacattttcagattcacagcattttaaaagcttccaagagttaaagctttgaaagcttttaaaatggtttattgatctaaagtgccagttgagaaggtctaatttatgtttcccagttataatagtattgtctatagtaatctatattcttctatctgtagtaatctatatccttttgaagtttgacaagttcattttccactatatttataccactccacttattccatcatttccaaggtattctatcatagctaaaacccaaaaataagtaaaaggtggaagaggcaccgtgtatacaaaagtataatgatttctttcattctttatttcaactaaggtagatgacataaatttcccattcaaacatggcatcaataggagacttcattgactacaatgaatcaaggttttctaaaaccttcaatagctaatttacactgagttagctgtacatgaaggacggaattgaatttgagtaagttattttattttttaaaaaaataacaaatgaaaactaattgtacttcattattcccaggaggcaaagaattatcaaggtacaatttaatgatgatgaattctaccccaagagaaacattagccctatggatttacttctcagtattttcattactccatatgcattatatatgcatttaaaaatttatatacatttttatgtcatttaagcaaaatataacttgacaataggaaatacctcttgagaattactgtcccagccatataaagagggtaaagataaaaatcaacgacaatgcagatcttgcaatacaatcataaatatgatttcaaagttaaattttatgctttttccagaccatgtttgttagaaatttactagaacactcttctggaacctctttcctacagttatgtaagttggatagcattaacaactttaagagagaactttgtcactcatttgacgaagaacaagcaatatattcatgaaatataaggcactagtgctaaaacggtgatcatttatgtggcattttatgctttctttatgttttctttataacacatatcacaattttcatttctttcatgtgtgctttcctagtggtcatttgccttacctttcctttgatgataagttccatgagatcatactgattttgctcactactatggtacatactgccagatggtagctgacacagactaggctccctttaatacctattgaatgaatgggtaaaaagaagcatatatttgtcagacatgtttctcatgggtctgttgtgaaagtcagtccatttgaacttgaacacctctgggatatacaaagaaagaaaaataatgagacaacaaaggatttggggtttaatattttgttatgtcgcatagctgtatggtaaatttggagagtatgctgttccccaaacttgctcctgacacatggtgactatttccaccattatttcttacacccaaaaaataaatagagctgtagatgccgcaaaagagtcattctgttgttgatatgaacaataaaatgaaaaataggaactagattacaaccagaatacggtcaaatggtttgttttatgataaaattgagtcattatccttacttatcattctcaccacaaaccccccaaaattaatatttcagctactgttatttattaaaatactaatcactgacataatttttaattaaacatcatggcattaaaccatgcttgcagagcaccattcaactaatcctgcatgtgtccttagcaaagaaattccagctgccactatttgatcagttagcactggcactgagatctagttttcactgttctggtcactctccatcttattacataattgtcaggtttgagaggacatgttcttcctactatagtaaaagagctggaataattcacaaatataatgcagtggtaaactaaaatgcatttcaacattgttggaaggcatatagaaagtatgtaaggaattttgcagaaataaattttacaatattttttgtagcgtggaaattgaatcaaaatgttaatgtttataatattcttgactaacgcatattgtatattaatcttgaaatgcataaatagtttttgtgaatcataaagaaaactataagaaaagatatagctcaatggtaattacttctttagtaaaatgttttaggaggaaaactatgtaagtgtaatcaataatgcggtgactttttacctggaattttaacaggattccaaagtaagcatacagaaaaagcactacaggtaaaatttattcagtacccaattcaaaagaaaataattacagtaaactattttaaacctcacattttcaagatgtcataatgtggttagctttttttttttcttgagacagagttgcgttctgtcccccaggctggagtgcagtggcatgatcttggctcactgcagcctctgcctcccgggttcaagcaattctcctgcatcagcctcccaagtagctgggattacaggcgcccaccaccacacctggctaatttttgtacttttggtagagacagggttttgccacattggccaggatggtctcgacctcctgacctcagatccgcccacctcggcctcccacagtgctgggattacagggtgagccaccatgcccggctaaacctgatgttttcaagatgtcatcatgtggttagcttttttttttttaagacctctactgtattgatgaatcacaaaactttgtaatataatggagaggaaccatgaaactattttgcaccacacaaaacctcaacagttatctccattactcactaattgaatcattcattctagtgtgtatttattgaattcataacattcaaagagtttaaaataagtagcatgttttacttttacagaagataatgttccaaattggcaacaattttggtagtaataaataatcatcaattgtaggatattaagcagagccttttgaaaaatataaattacatttaatcaacctttttaaagaaaaagtgacatttcaacaagtgacagtgtaattgattattttacaatagtattttatttttctatttatttatttattttttattttttgagataggatctcactctgtcgccaggatggagtacagtggtatgatcttggctcactgaggccttgatctcctgggctcaatcagtcctcctacctcagccacccaagtagctgggatcacaggtgtgcgccaccatgccagctaatttttaaatttttgtggagatggagtctccctatgtttcccagggggaaaaaattgaaatatcagtcccaaatcaacatgtcctgtgctctgtgatagtagttcctgtctgagaattttaaggggacatggacttgagaggtttaaaaacagaagctactcaccaagcattatcttaaattcctgggctcaagtgattctcccacctcggcctccgaaagtgctgggattacaggcatgagccaccacacccagcccgacagtttatttatttttttaaatgctttcatcattaagtgttctttttctgctgaaaataatatatcactactttcaaactcttatattcatgtttgaaacttggaaacagaatttcttctcctctgaaaaacctctccaagatctctcaacacctagcacccaagttgtgtttcctaaatgctattcttcagtgaaaggtggctttgaacctaagcttaaaaatgttaaaaccaacaacttctgattacttttcaaaaacattgactgatttcagagaaagataaattaattaactcaatttcattgaaaaatgtacataatcacaattgagattgaagatcaggcaccatttttctttccttttcttttagagatagggtctcactcagtcacccaggagtggcgcaaccttggctctctgcaacctcaaactcgtgggctcaagcaatcttcttgtctcagcctcccaagtagttgggattacagatgcataccactgcacccagctaattttgttaaattattttttatggagatggggtctcactgtattgcccaggctggtatcaaactctaggcctcaaatgatccttccacttcggcctcccgaagtgcttggattacaggtatgagccaccacacttggccaagaataatttttcataaatcattttatttaaatatctgtattttccaatattattatattaaataagacagacactaaaagcaaatattgaaaaaaattaaattaaaaaatagattcaaattttcaaaataatgaaatatattcaatcatgttgcactcactaaaaatgttagtacattatgctagtgaaagcaatggtgtttttgcattgttaataaaaaataaaattattttatatttatctcatctttctgaagttacatatatgttcaaactttatgtgaaagttcgaatatatatataatatattatgactacatgtagttaatgtgttataaataactatccatatatgtgaatgcctatgttgaggcttagaaaacgataccccaaagtatggtgctttggtgtgctgagcactttgaactaaaaaaaattaaaaggccttagaagcagcctcagaaccaatgactgtctaacctttatttctccccctaagtgcaggatggaacactgtctctgaagttcccttatctgtagctctttcagaaggaacataattgccttgaatccccttcctgagatttcattaaccagagcattaaactcacgtggtaggagggaagactaaggaatgttaccacacctgtcccattccatttccaaagagaaccatttacaaactattgtctgttctttgggctcaatcaactctcctaaagattatttactacctctccaaattgcctccattaccccatctccctctgctctatgaagagggtgctatttaaattctacccatttagcccttctttgagtcgcatatttcacatggctcccatacacacttgcacatttacaaatctgtatgctttttctgttaatctattgtcagtttatttcagcaaactcaaaccttcagagaggaagtgaaaaatcccttttttcctatacttgttcaaaaatgttgtactgataagaatgaggaatcaaaaaaatggaaatatcagtcccaaatcaacatttcctgtgttctgtgatagtagttcctgtctgagagttttaaggggacatgaacaggtttgaaaatggaagctactcaccaagctttattacccttatcttcacgcattagcagaaacttgtttttgtgggctgcttgtaattgtcagtttattatcaagtcaatgtgggatgctttgtgatgtaatttagagcagagaaaagtaagaactagcagttgcctagaatggggacctcagccattttttatcattcaacctctccatctatgtgatgagacaactccttgacaaaggaattaacagacactgagaaagatttttttgtgcctcctggcagagtaaaaatccaactcagagtagtaaaaaacctgtatactccatgcctgaagttatgaagatctggaaactgcagatggatctgaggggacaatgaaataagaattctttcacaggagcactggagaagcaaagatcctaggaagatagctatgctaacttgtctagagaggacagagcatctgtatacctctgcctcccaccccagccttaagagacttagaggctttaggaacaagacaactaaaaaagggcatgtcacctgattttctgacaccctctttaaactaaaaataaaatcccaagccccccaattcaccgaacagaccccctcttggccaaggagacccaagagaaatctgaaaaactgagttcttagccatcacaggaagattgaacacgccttgttacatgccatccctgctagcgtttagacaaaactgagtagcattagtgttaaaatagagatcataaggctgacaaaacagactctttgtgacactaagataccagcttataaacaagaccctgagtccatgcaaggccaagggttaagtcatgcctgtaggtcattaatcttactacatgacatcctaaccttaaattaaaaccttccggccaggagcagtggctcatgcctgtaatcccagcactttgggaggccaaggcaggtggatcatgaggtcaagagatcgagaccatcctggccaacatggtgaaaccctgtgtctaccaaaaatataaaaaattagctaggtgtggtggcacgcacctgtaatcccagctactcgggaggctgaggcaggagaattgcttgaacccaggaggcggaggttgcagtgagctgagatcgtgccactgcactcaagcctgggtgacagagtgagactccctctcaaaaaaaaccttcctttctgctgattacaagttttaaacagaggtttacttctttaaccagttgcaaataagagaatctctgaatccacttatcacctgtaagcccctcatttcaagatatcttgcctgctcaggccaaaccaacatatacttcccatgtgttgatttatgtctttgcctgtaataactcttgtccctttaaaattcatagaaccaaactggaatccaactgcctaaggcacactttctcaggacctcttgagaccattttccctgggcatggtcactcatattggctcagaataaacctttttaaaatattttagagtttgatgggttttttgttgttgttaataccctactccctctttttcccttgcaaacttaaaatgctttttgacttcggaaaattaacaagactcttaaaacaaatatttaatctttgtgcagctgaggcaaacaaggtaatatccaagacagatagaggaaggtaatggcttttccctctgatcataggaagtgtgaggaaaagcagtaatgagcaaaagcagatccagcagaaaatccatgggctctatcatcctgaccactctcccaagtgaagagcttgatttacatcctgagggactggggagagggagagggagagggagaagaaagaaagaagaagaagaggaagaagaagaagaggaagaggaagaggaagaagaaagaggaggaaaaggaggtagatgatgccacctattactcaagttatataatgatgacccagtgacatgaaattaaattgttaccaaatgccaggggtttggtctagatcccattgctcaccatacagaatgccaatgcctgatacaagaagtattgccaggaaagaagactttatttgtgagctgcagtcaagaagaacaggagataagtctcaaatccttttccttgacccactaaaatttggggcttacatagcagagaagggatgtcactacatgcaggaatacaggaatgagggaggggtaagggagcaatcacgatgggtaagagaccttagatctcatggtctggatatggtgatctggtgagtttcagtcccttgcgtgagggtctgtttcctgaggaaaccactcagatgagacacatataagtttcaagttttaagagtgggagggttaatttctacctttattcaaaaacccataaatatttcaaagggacaactgggcctttcaaaaagactggagcaatttagtcaattcgctcaacaattctaatctaccccaacagcaatctagaatagaaatgggcaaactgtagcccgcagatagtttgggtgggcaaactgcatcaaacacaaaaactttatctcagtactaaagatcagatttctgttgcttcataaaagtgcaaaaatattaaccattaatttttaattaaagccagtgtgaatgttctcaccaacactattctagtcaattgcataggctgtacatatttttaaaatgtgtattctcttatgggactgcgtaaaattatttttattttgagaggagaagttttgttttataagttttttatttttcctgaattagcatttattagaaagagagaaaaagttgctcagcttctatgtaccacgctcaaataaaaggaatcagggctccttggagaaatggcagattccattgttggacggggagaatacaagtcaagcctgagtcatcttctggtgtcagaaataaggaagtgctcaaaaacgtatggaagctgtccaaggaagagaagctaactggaaagagctccaatggccaaagtaggaacaacctgagaaacaaatagatgacattattgagttagtacttctagaatataataaatatccatgagtccatattgatataaacacataattgagtgaaaaataaatgaggagaagggataactcttcctcatagaaaaaaaattaactaataagtgtagaagtgggggaagtactaaatcaccattgggcgaatatgacagtaataattgttgaagacaagagccactgacaaatgctgaaaaagggtaggcaaagatttgaggagaaacagggtattacaatagtctcataaatcttccccaaaattgtgatcaattgtgaagataaaatagcaattttatagtggataaatccagcacatactatcctatttatgtgattatttatgtgattatagttggtattaccagtaataagacatcaaggtcatgtaccccctgagaaggacccaatgtcacttctgtgttatttttggtaaaaatacataacaaaaatctagtcatgagaaaacatcagaggcattttacaaagtaactcaaactcactgtctctcactaaaagcgtcaaggtcacaagacaaagacacaatgacaaaccgtcacagattagaggaaactaaggaggtatcacaactaagtgcaatggaggaagctgggttaaattcaggagaagaaaaagaacattaggggaaatactggtaaaatcctaataagatctattgctcaaaactatggtatcaatcttaatgccttggtttttgatcattgtacaatggctatgtcagttgctcacattagggaaatatgagaactctgagcaatttgcactttttctgtaagtctaaaattatttcaaaataaaaagggatttgtctttagtttgtttgtttgtttgttttaatggtgttcatcacttgtttagcattgatagccaatctatgtgaagggaatttacaatgatgaaaatcatttctattaagtactgtggagagaacagataaatgaagagcacttcaaaaagtgatttagcaaaacaatgaataatgtaaattgtatgtgtgggtcgacagctgaagtgcttcaagaatgctctcaacagaagaataaatgttgaccattttactggaacagtagacacaaaaccatccatgtgtatataacgatgaaataattaataaaggtagctaatttttattgaatcttacttgcaaggcacataaaatctcccgaaaagctgacgagttaaatatattttttgacctcttcacacagtcaaatagcttccacaaggttatacagataataagaagctgagctgtgattttaactcaggctgatgaagctccaagccaatacacctgaccactaggctacatgatatacctttgatctctgagctttaagtttattctgtggcagaaatgctaggtttgcattttaccactttccattgctcctaatgaagagcagtaggcatccatgactagagaaagagctcccgttagtgattataaaacagtttttttctctttgaaaagcagaaaatgatcacaaccttgagttcacagttaccactctctaaccctttcagctaaattggccagacaactctaatgtcacaggtgtgctgtgacagcaacttcatccaactgagcaataggccctctccacaagttaagctcagtctaatattagagggtgccatgctcaaccaatcaatacaagcagaggaataagtcctagccaatttagtggccattcagctgattgtagtttgccttttgtaattttgttattttgggctttgttttatatatataaaaactttaaaatggccctaattttccagtccctggaatttcaaaaagagcatggaaggtttccaaaaatgcagcctagaattgcaatctacgtgttgtgctttaacatataagcacattcattaatgagaaatttgaaggaaataaatgtctggttctcatctctacagaaacagcacacaaaagttttaataaatgctatatttaatataaaataattatgtcttgttctactgctgttatcaacattagtcttcttcataggtaaacttgcaaaatatgccattaatgtgttgaatgataatatctttttaaatttaaacatctgacttttttccaaattcataaaatgaaaaatcagaggggttttccagtctataaaatgtgggagaaggaagaaattaacacaagtgcttaaccacaagccctctgaacattcctaacccactggactagaaaatcttaagagggctgacttctaagatatgcagtacctagtggtgagggccagcccggagaagtcataagaatactaagccaagtgttaattccctaatcatcccactatttcaagctctggtggagggaatagagaagggtcatttctgaccattgagggacttttttctagcagtttctgccaaagttcgaaatagcagtcacatgatttctggtcaaaatgatgaacttgtgtgaacctcaaaaacactgaaagttcatctcagtttggtgatctaactggaagtaatttttaaataagaaaatatttttaagtccatggaaaaacactaaactcattattgtttcatttctcttttataaaaaatgtgatgtatgaaaaactgagggtctgctttaatttgacaataatatattttcttcagctttgatttgaactgttttaaagatctgtatacctgggactcaagaatctccgattcaatgctaattagctgaatgctacgggcaagtcatttaacatctttggcctttggtctgtgtctgcaaaatgagagtgtgtaaataaattctaatgcacagtttagtcaccaaaaagaattctaaatttaaattttgtatttgcagaaaatagacattgaccattgacattttagtgctgatgcggatgagttcttttaaagtttcataagttttgaactacagctttttttttgttttctcttaagtggttagaaaaagaattctacagatgacttaaaatggtgtcagttagttcatccacatcaataattgctgaaagaaaagcaactttcaatattaagttgaaaattggaagctgtaggtcatattgactgctttacttttctctaatgattctgttttgtactatgttgtatgtataaaaagacctttttctaaaagtctctcgagtactaaacacacggttgttgaagctttatcatgaggctctcaagaaaaagagggtagaggagtattttatttataattgaatcacaaagtgttatgcacatttgtaaaggatgccttttaaaaatctgttttgctcttaatatttattaaactcatccacacataaaactccttgcctttctttcttatccgtgtctatttcttcttataattccctatcctaatggctatgaaaacacaggcatatgactggaaataaatctttaaataaagaaagaaaagtcactcaaaggagaatggagattaatagacagcatagtcggtttcctgtttggaacagcctcagcgagtttctttttcctcctattctctcctgaaaaatggaaccacaaaagaccaaggctcagtgaacattctttatgtttttttcatgtaaaataaataagaaatttttgatgcccattagctttaatagagggcagaactttacttctactgatcataattcttttacttttaagtgagaatttggactgactataccatatgtgaacattgacacagatactgcccgatgataatcacatcaaggttcactgtagtgattctggctctgaaaagtctattagagtgatggccattcccactttgatatctaaatgtattttcaaattcaatcaatgtaggccaggcgtggtggctcacacctgtaatcccagcactttgggaggctgaggtgggtggattacttgacgtcaggagttcaagaccagtgtggccaacatggtgaaactccatctctactaaaaatacaaaaacattagctgggcgtggtggtgcacatgtgtggtcccagctatttgggaggctgaggcaggagaattgcttgaacccaggagacggaggttgtagtgagccgagatcacaccactgtactccagcctgggcaatagagtgagactccatctgaaaacacacacacacacacacacacacacacacacaaaatcaatccataactagatgtatgcttttccctacaaaataactcatatcttttgactcccccaataatgttgattccactactactctttaaatcaaccaggtggttaaacattgtgtcatctttgatttctgcctttcctcaacatctcaaagcactgctcatcaagcccgatggctttcctcatgatacctgcatctcttcaccatatttcttcttctccagccactgtgtgaattcaaaaccaaatcaccactgagttcctggcacactaatttatttacctattcatgtagtaatgccaataaaattaagcagtcagagcaaaataaggaaaaagtaacgactatgttatttgcagagatatgaagagacgtaggggagggatggagattttaaatgatggacatagagattaaatacaggtagggatgggttagggacacagatacggtgcagatacagattccggtggagggattttcaacaacttggtacctacaaaattgtagcagtatacttgataaaagacatctttattttttcaaagaaaacattaagtaagcttgaagatgcctggaaaagggatattcagatttaaataggatcccaaggtcttctggaagggaagagatcaaaactcaacatttcccaaaagtttttatgcaaattgggatagacagagaaggcccaaccaggacccagtggtgaagaagcaataaagaaagtgaagggcaacaaattcctaagataaaatccctgtgagaatcaaagagtcaggtaacagtggtggtccctgaacctggacgtggtcattatgagaagctatctgtctgagtctatggtgcatccactctggccccaactcagacctgtgagctgcagattgtaaccacagaaagtaggtggtggtggagtcagaaaatgctaccccaaagtgaaggcctcagaagcaaagtttctctttgactttcttctgccctcctgtctcactctcattctgccctgaggcaagacacagaaaatagaatttctcttccccagggtagatcatacaaaacagaaccctttttccccaaaggcagccataaagtgaaaaatattactctaattttcctcacctttctgtgtcacagctggccataacgaaactctcagcctgggcaacatatcaagaacccacttcaacaaaaaatagaaaataaaaataaattaagcaggtgttgtggtgcgtgctggtagtcctggctacttaggaagcagaggcaggaggatggcttaagccctggagttcaaggctgcagtgagccgtgattattccattgcactctcatctgggtgacggagagagaccctttctctaaaaaacaaacaaacaaaaaaactctataatcccagcactttgggagaccaaggtggacagatcacctgaggtcaggagttcaagaccaacctggccaacatggtgaaaccccatctctactaaaaatacaaaaattagctgggtgtggtggcgcacgtctgtagtcccaggtacttagaaggctgaggcaagagagtcatttgaacctgggaggcggaggttgcagtgagctgacattgcgcctctgcactccagcctgggtgacagagcgagactccgtctaaaacaaaaaaaagaaagaaagacagaaaaaaaaaaattatttgacttactttgtcgattatgaatcttaaaacccccgttccaaaagggtcaggccccagaagtccaggaagactccaaacagatgggccttgctgggcttccccctcattccactgctataagattagatcctttttggccagacacagtgattcacgcctgtaatgccagtgggtccggaattggtgggttcttggtctcactgacttcaagaatgaagccgcgaaccctcgcagtgagtgttacagttcttaaaggctgcgtgtctggagctcgttccttctgatgttcggatgtgttggcagtttcttccttctggtgggttcttggtctcgctggctcaggagtgaagctgcggatcttcgaggtgagtgttatagctcttaaggcggcacgtctgcagtcgttcgttccttctggtgggctcgtggtctcgctggcttcaggactgaagctgcagaccttcacagtgagtgttacagctcataaaggcagtgtggacccaaggagtgagcagcagcaagaattattgcaaagagcgaaagaacaaacctcccacagcgtggaagggaaccccagcaggttaccactgctggctggggcagcctgcttttattctcttatctggccccacccacatcctgctgattggtagagccgagtggtctgttttgacagggcgctgattggtgcgtttacaatccctgagctagacacaaaggttctccaggtccccaccagagtagctagatacagagtgtggattggtgcattcacaaaccctgagctagacacagggtgctgattggtgtgtttacaaaccttgagctagatacagagtgcccactggtgtatttacaatccctgagctagacataaaggttctccacgtccccaccagactcaggagcccagctagcttcacccagtggatcctgcaccggggctgcaggtggagctgcctgccagtcccacgccatgcgcctgcactcctcagcccttgggtggtcgatgggactgggcactgtggagcagggggtggccctcgtcggggaggctcgggctgcacaggagcccactggaggtgtggggagtctcaggcatggcaggctgcaggtcccgagcccttccctgccctgcgggaaggcagctaaggcctggcgagaaattgagcacagcagctgctggcccaggtactaagcccctcactgcccaggccggtgggaccggcgggccgctccgagagtggggaccgctgagcccacgcccacccgaactcgcgctggcccgcaagcaccgtgcgcagccctggttcccgcccacgcctctccctccacatctccctgcaagctgagagagccagctctggccttggcccgcccaggaaggggctcccacaatgcagcagtgggctgaagggctcctcaagtgccgccaaagtgggagcccaggcagaggaggcgctgagagcaagtgagggctgtgaggactgccggcacgctgtcacctctcaccagcactttgggagtctgaggcgggaggatcacctgaggtcaggagttcgagaccagcctggccaatatggtgaaaccccacctctactaaaaaaaaaaatatatatatatatatattaggtgggtgtggtggcacgtgcctgtagtcccagctactcaggaggctgaggcaggagaattgcttgaacctgaaaggcagaggttgcagtaagcactccagcctgggcaacacagcaagactccgtctaaaaaaaaaaaaaaaaaaaagattcaaccctttttgttcaattgtatttctgcaaagttgtctctgcttcatagaacctaagcatcaagtcacatcagatagcttctggtatcttttgagtcttcaatctgaaagctcccctgtcatgtaaaactatgatgaaataaatgtgttatgcttttctcttcattattttttgttataggaatgtcagcaccagctttatgatggggaggagacggatcactcttttctgctcctacattgttctcatgagcaactcaaattacagtttgataaaaactaaatgttggaaactcatctatttgacacggagggacaatacctgcaaatgaacaccaggaaagaagcattcttcttcccctctgagtattcacagccaggcctgcagtagaaggatattccagtagatgccagaatgttcatttcagtggctacatacgcctcatttgccacagggtccacatcagacctgtgagtactggcagcccaggaacagcggcagctgcattgaaagtgagcccacctcgtgaacaatggtttccttcccttgccctttccttttcctttttcctttccttgcctctccttttcttttctcttattcatcatacaatagtaatcaggactgattgcttgcagaccgagtaagtcttgtggtaagaaatcgacaggttaatggaaggaataggagatcagggagagagaatgctaacttggtatttcaggagtctatctgagtcaactttcacacccaaaatgttaaaaatggaccatttgacttataaagaaaatgttaaaaccctctggggaaaatggtggcctgaaacaattggcacattgcaaataatgcaacttttaatgctgaaggaaagaagctgttctttcgagtctgaagacttgattctattcttacatatgacaaactctaacaatggatgaccttaaagttttgatattttacctatggttctcatttaaaacagaaaaaaatcattaccggataataagtcagactgttttcttatctgccttgatcaagaaaagttagatgttgtcagtgtctttgaaagttctgctaggaagcaagatattcccagcagtttacttgagcaaatggcttccgtttagcctaacggtttcttaggtttcacttttaaatcctgtgttaaacagagcaagtcactgtcattcaaacttttcccaagctgtatggggctctattgctgttgtttaacgaaattcagaggctagtgtaattagaccgcagggaaggtaggtcaggcagtgctgttaacttggctggcaaagttgatgggtcaaaaatgttttatgtttttcttcttttttcgcactaaataaactcggtgtaaaaatgttttgcttatagtgctcttctattcatttaacataaacatttgtgtattttaattctgtctgttctaaaattctaatttcttctataaattaatcaaatatgaaatctaagccagcaaagtatgttagaggaacagtgagtcaagttttataaaaattaggcaggtatggaacagagctttaaaactgtatgatatttggagggaatggagtaagaaacagaaaccagttttctgaagggtatttattgttattattattaaataaacacattattgcgtgttctgtgagcagttctttcttgataggaatactgacaatacctgttatattattatgaaattaaacttatctcttttcaaaaataaattcacacaccgtgaccccaaagtgtgaaggatcacaagatgtgtgacaaagaatgcattcagcaaggactggtaaagtgctggaaaccccaagggacgtgagttatatttcatggaactgagtctaggatttggaaattattttgcaattatttattgttggtctcgagagtgtacgtttcatgtatttcttcctttttacccagaatgtaattttgcttggtggtgaccatgtgagaaaaatagcactgtgggaagcgttcttgtgcagttttcactgtaatccgatcaatacaataaacagtttgaaagctattcatcatacaaaaataaacaactattaggtagctgttggtccaatgctcataaacatgaacaatttacacaagaaagaaagtatactaacaggaaaaaaaagccatagacaaataacaaattatctcctaagaaaatgttttatttcggatccgccccccacccccaacacacattatattaaagcatcaggaaaaatggcagtgaaccaatcatcgtgaatgactaaaatacaaattaaaacctgggttaatcatggggaaaaatcaggtaaaaattaaagcaggattatacttgggttttcactagcagggtattctaggatggaattatgtatcagtcaccaataagtagctctggcatgttcaccccgtgtttgccacctgaatgttgtttgcaccagactcacatttatcattttcatgctttgatatcagaaactgggaagtcatacttgactcttatttttttcttgctctatctcattcaagcatcacttctaatttggcctccctactatttcttacacgtgtttctgcttttccgtatctcctatcacttgactggtttacgttccattatattttacttcaatggcctcctttgattctatctagcatcttatctcccctaattcattttgaaacagccaaacatctccccagtaagatacaaatgtgcggccgggcgcggtggctcacgcctgtaatcccagcactttgggaggccgaggcggtcggatcatgaggtcaggagatccagaccatcctggctaacacggtgaaaccccgtatctactaaaaatacaaaaaaaaattagccgggcgtggttgcgggcgcctgtagtcccagctactcgggaggctgaggcaggagaatggcttgaacccaggaggcggagcttgcagtgagccgagatcacgccactgcactccagcctgggcgacagagcgagactctgtctcaaaaataatattaatttaaaaaattaaaaaaatacaaatgtgcaaatgtcagagtacccttgtttatgacactgaaacgacacatgtataacacttccacgatctggcccatgtcattatctcttgctactctatctcagacattaatttaccaacttaaaaatacttgggcacatatgtgccaggcgttgtgccatacattatagcatcttcagaatttagcatagtgttttcaacataagaagaactcaataaatattctaccctctaaatatttcttgaagggactgtttccattccatgcacgctaataccacccagcccaagtcagggtcttgttcggatactcaccagcttcctaattctaacacctaactctaatctaatctctacttcctatggccagagggattaaaattaaaattctggtcatgttatttccaaacctaaaattttgcaaagggtccccaatgaatctatgacaaattgtaaaatcctaacctgattcataagtccttacatgtaccttccttcaggcttactcttagtctctctttctccctctctacattccattgcttctctttctcttttctttgttaaatcctacttatccatcaggtctcaatttaaacaccaatttctttgtgtgacagtccctggccctcttgactaggttaaattatttttctctgcattaccatggcatcacttcgtggagctcatcacacttgtaattacttgcttaatgtctgtaacttcctcagagacactttccctaatccccttgataaggggaagtataggtatcaagcactctcagaggtcactgtatttctctttagcatacatcacagctcaataattgttttgttgagttgaatttcagatacatctccagtcctcagggaactttgaggcttggctgtaccagtacctctgttactcctagaaaattctttctcattgtttaagtctcagctctcctgtcagcaaccccaggagcctttgctcatcgaacttcacatcactcccaagctgaattcgatctctctcctccatactcacatcctaccttatgtacatttctgtcattgcacttgccagaatctacttcagttatctgtttatgggtctgtcttcctggaaagtagtttccttgagataagggatgatatcttatgttttgcattccatacataataaatatttcttgaatgaatgcatgagtgagtacatgtaaaataggaattagatgacctcttgctgccaagtaatatgcatcctgtaacaggaatgagggccatcccagcagcagtgctgtgtggactgatggacagggccttcatggactcacaccctaggctttgacattttgtggatataaccctgactagactgaaattgtttttgagtcccttataaaatgagttaccaaaagagcatttaaactgaatgataaaatagaaataaaattatattcatttcaatcataaatctgtacaatgagaattgtattccctagatatatacataaatacataccaatatggatatagaaacagatatacatataggtataggtatagtggtggtagaataataacccccaaagatgttcacattctagtcttttgtgccttatatggcaaaaaggacctgcaagtatgattgcagtgaggattgttttgcagatatgattgtagtgaggattgttttgcagatatgattgtagtgaggattgttttgcagatatgattatggtaaggttcatgagatgggtaggttttcctgggtcttctaggtgggcccaatataatcacaaggggccctgtgagcaagaggcaagaatgtcagagtcggggagagatctgaagatgcaacactgctagctttcaaaatggaggaagggaccaggagcaaaggaaggcaagtgcttctatgaacttcagaacacaagggaatagattttccctgagaacctccagaaagaacacaactttgcttataacttcatcttggcccagtgagacttctgacctatagaactgtaagatgataaagttgttttgttttgagctggtaagtttgttgtaatttgttacaccagcaacagcaagcatatacgtacatgtatatgtcaatgcatatgtatttgtatatgtgtatatggtgcatatttgctagtactccaataccattgcctttacattgcttaagaacctagaggcaggtgccaggcacagtggctcatacccgtaatcccagtactttaggaggcagaggcagaaggatcgcttgagccaaggagttcaagaccagcctaggcagtacagtgtgagactccatctctacaaaaaataaaaaattaaccaggtgtagttgtgtgtacctttagtcccggctactcaggaggctgaggtgggaggatcacttgaacccaggatgtcaagcctgcagttagccatggttgtgtcacggcactctagtttgggtgacagagtgagaccttgtctcaaaaaaataaaaaggtctagagtaagagacagacaacagtacacgtatcatcatatacttagacctgtggtaggtgctaagaaaaaccatagtgactaatgagaatattgaacatccaccatgctttccttgtcaagagaattaggaattacatttgcatgcacacacacttttcccactagtccaaagttacagacacagagctggtcatctgtttatatttcatgaggttgattttgtatcatttatatacattcaataaataattgtttgaagagaagtaagagcacaggaatttttgaatatggcactttacttgcaaatatattttacttatgttcacattgccaaggcagaactagagagttttcaatcatgtttctaaaagaaactacttctgggcgcaatggcaatttcagcactttgagaggccgagacgggtggatcacatgaggccaggagttccagacctgcctggccaacatagtgaaaccctgtctctactaaaaatacaaaaaaattggttgggcatggtggcatgtgcctgtggtcccagctgcttgggaggctaaggcataagaatcgcttgaacccaggaggtggaggttgcagtgagctgagatcacaacactgcactccagcctgggagacagagggagaatctgactcaaaaaataaataaataaataaataaataaataaataaataaatagtaaagaaaagaaactaatagagattgtaaaaataaacatttgagcctagaagaatcttaaaagagtttatcaatttggaatatttcaatatctattatgagacatccccaagtccccatatattgctctgacagaatattatgctaattagcacagttaatctcctttccatccaagacattttatttttaattagttaaaaatatttgtggttatttctcatagaagaattaaaaataaactcctttatatattttaaggtaacattgtttcaaaaacaataatagttacataggtaagtatttcttcattatatctaaaatatcatgattgcttttgttgtcagaaataaaaccatcccccttgctgacaaccagtcacatttcttccagggaaagactacccacaatcctgcagaattacacagtgtgtattaaatataacacagataattaactcagagaactgacagtcatttgttggcatactcaaataaaaactgtagcatacccctcacaatcccaacattctgcactattttatcatgtgttgcgagttcttgttgtttttattggcataattaattacttgtataactggaaatgtgcagaaaacatacatgaaccattcatcagaacttgcatcacacattactttttaatacactcattcaggagatatgtagtgaagaccacagaagacagatactagaagagttttttgttttttcacagtttgctcaaaaaagaaactagagcatttgaaatgatggtcttttaaaatatgttaacattataggtcagaaagtctgaggctaatcttttatctcctgcaagggttttgtgattaaaggagaaataactacttgatatttttttctggtcttataagattgggtttatattcccaaataatatcgaggaagaaacagcctttaaaggatttaatctagagaagtaaatcaaagaactgaagttcaacttaaatggtcgattgaatttgagatatctaagtctaatcttaattctggtgtagatctcttaaggacaagaccacataagtattctttttttttttttttttttttttttttttttttgagacggagtctcgctctgtcgcccaggtcggactgcggactgcagtggcgcaatctcggctcactgcaagctccgcttcccgggttcacgccattctcctgcctcagcctcccgagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgcgcccggccaagtattcttaaatgttatacaatatctatgtttaatgactatattcactagaattgtaaagattcaagatattctcataatatttaaaacaaatttttaaaaatataactttctatagtggcagaatatattatccaaagatgttatattctattaaattatttcctaaatattaatagatggtacgcaaaaatgtattctgtgtcaaatatgcctggaaaatcttgatagaaagtattgatttttttttcactgcaggacttattagagtcttgaaatgttaatgagtatagtgaatttccaagaaaagaaaagatataacatgcagtgcttcatcagctaggatactcagtcctagttctcttaactctataatcctgccttctgcaacaggtaaagggttctaagttgaaatgatgctgcttccaagtacagccaaattctctaaaacaatctgagagttacattctcatgtcttaccaggaattctaggtacagagaatacttgttggaatccgagttatggatcctaactgaaattaacttcagttatttatggacctatagagcattcattcatcctatgtgggattgactcctcatttttgggggtgtccttctgttttaattaccccttatgtgccccatcagggagggaggagttcctgtcatatggttatggggagggccaaatacacgacagccaacactggttggacaaactcaacaattgtgcatgagctcacagcctgtgtgggagggcactccatgccatgcaggaccacatgggggctgagcttgagagcagagggaacagcaagggactgggggaggcagattttgcagtatcaagaagatgaggtgccccttggttcccacaggagtatgcgattggcttgtttgaataattttgcaggctggcaaagaactgaaacccactactcagggataagcaggagctgtgcctgggccccttggtaagaagggttgcttggctaggcccttatctgcagagcacagtcagaaaggaaacttgcagttaggctattcaaggcccacctggcaacacacgtcaaggcaacacataacactgaatcttgatctgggccttccaccacatcccctttcatccacacccagtgcaggtggttggataaggcttatccaacccctagaaccagacgaggacgggtggccttggtgtaaatgtctcaaagcccccacccacagagattagttcaggaataaatttgtcagccaattcatgccaattaaagccaaactgagaattgtgtaagggtactataggaaagagatatgctattttctgatgaagtaactgctctcagtgagagtgatgtgagcctggtattctgaaggacctgatgcagagcctgaaaatgaagccaccatgtgaaaagcagggcctagaaatggacacggaaatagaacaaggtcagctgaccttgctaaatctgtatccagtcatccctgaaacctctctacatctggactttccaggcatgtaaaacattccttttccatttctgattaagctgatttgagttgaattttgtcacctaccattttagtagttcttactgatatgtgaactaaactgagttaatgcctgcacacctataatgaatggttttgcatgaggaccacttcaccacgttacttctggcaatattttagagaaactctgcagtttcctcactcataacctgaaccaaattatggttccctttccacgtcacctcattagatatctctttaaataatgttattgctatacaagctaaagcagcattaccactactacaaaataaacaatctttgatggccacccgcacaaaaaaaataagaacataatgagaaagaaatgaaggataactaccgtggcatgagtcccttttagaagatagtagtcgatttgatcaattcatagtcaatccacaaatctctatcataacttaaataaatatcataaaatcttttaaaacaccctcagctcaatactatgaaatgagaaatgatttttcaaactctgagcaggcaggtggcactttttgttcataaagaagaagcacatgtggtacagggaaggacaaataaaatgtgatgactattgctcaacaaataacttggaaacacaagtaaatcaaatgttagaacttgtatttccaactttgaatgttttcttaaagaaaacatgagcagaattatcaacaacatctacacagtctttggtatattcacccagataaatcctgcaactcacagccactccgcagtgacttgaagcagcagaactactcttaacatttacacttgcttgatgagaagatgttgaaatactcacaagtacacttactaaataaaagaaatggcagtgctcaccggctacctccaaatgttgacaagggacacagaggtacatgtggcagatgctttcaaaatgctaagttgtacatgaaagaaaatgaagccagatttctagtgtttctttatgcatcttgatctacattggcttatctatcagaaatacagtttataaatataaaagaaaaaatatgctgtcagaaagcaattaatagagattaatctgaatttagaaagtaacagtatcagatgacaaggaaccttaaggcctgacttagtcattccttaatattttactctggtgattatgagcactgaatcagtaacttatgaaatatattaatctgctaattttgtcatttccttgatgaatgtgagagaatttcaaagggagattatgaaggcactcacatatactttgtcaatgtaccagaaggttttcaataaatgcagtgtgtagccaggtgcagtggcttatgcctgtaatcccagcactttgggaggccaaggcaggaggatcgcttgagctcaggagtttgagaccagcctgggcaacatagtgagaccttgtctcttctaaaaattaaaaaaaaaattgtttaagatagccaggcattgtgatatgaacctgtagtcctagctactcacaggctgtggtggaaggattatttgtgcctgaaggtcaaggctgcagtaagctgtgatggtgccactgcagtctagcctgggtaaaagaccaaggccctgcctcaaaagaaaatataaataaataaaaataaaaataaaaaataaaaataaaatatatatacatatatatacacacagcacatataacttttaaaatacattttaagtattagaagcctaattcattaatagcactatagagagaggagtgaaatttttcaagtactgtttataggtgcaagctatgtaattaatgtaatctaaaagctataaaatgggaggatgaatgggaactattcaaaatgtacccttgtttggcctgtaacttcatttctctcccttcatgcatttgagctcacagaaggtggaggttatacaggcttggagtgaagaactgtgatgaggaaatccctactgattccctttaacactcatttacaaccaaaagtctctgaatagttatttttttttcttcacagaatgagagtttcataatacataaaagcccttttttctttccttttttttttaattgagtaaaagtgctagcccatgatgttagccagtaattcagttggtatgtttgaaaaaaatcctctgacttcacaaacttgtaagccggtatttataagataatatgtaaagtgaaaatgtgcctgttgtatgaaagctaactgacttgtctcaagtatagagctgattggaaggtactgtttattggttgaattgctatattatattaaaacctatactgtataagagtcaccatttaatagtaacaccacattctttcaattttctagaaacaattcaactttatatttttgttacaaataagatgtttgcactcaatttttatatcagtattgctgttggattaactattacatttttctcaagtaaggctattgtaaacctgggatcagatccagcagtctttctgtgtttaaatctggaacaacattactgtgatacaaatgaatggcttccacctagattaattatgtttgagctgcaaatgaatgcatatgctgtatctatgaatttgcaaatacaaagcaggggctccctctgcatagccatctgtgcattgcttttgtctctgggattttttaatatagataataaagcctaatcctctttaaaatcaggagaagataattggaatatgaggctaaccacatgtaatgcaatgatattatttcctaactactcataactttgaaataatagtagtaatagcagtaataaatgtgttttttatgaaacagtctactattaggccacaatttaaaagttataaaaatattaaatattataattgcaagtgaaaaattatagcaaagtccctaaactgaggacacattgaaaatatcacaaactaagcaatctttttttttgaaacaaggtgctgcttgacctcatgggctcaagcaatcctacctcagcctcccgagtagctaggattaaaggcacaagccactgtccatggctaatttttgtgtgtgtatgattgttttgtagagacagagtcttgctatgttgcctagactgatctcaaactcctggcatcaagcaaacctccttccttggcctcccaaagtatcaggaatacatgtttgggccaccatgcctggccatttgtgcaatcttcttgttacatttgggccactgaagagataaaatgcaaaaagaattctgaatgtgtgtcctaagaatgagaagagtatatattaattacgtcagatatctactgtcagcaccaaatagctgacttctgcacatgaatcaaccaatagcctagctctgcatgtgctcatcctcaactccaatgacaggtactttgtcttcatttccacagcccatcccaggattctgcctccaagctgctgcatcaaatctctcctgagtttctagcccacctccttgccctgtggatttcaaactcaagactgcagtatcagttcccaacttagtttccagcctgctggtccaccgtacagatttcaaacttctaatactccacaatcacagaagccaggtccttaaggtgtgtgtgtgtgtgtgtgtgtgtgtgtgtgtgttagtctcatcaggctgccaatacaaataccatagattgggtggcttaaataattgaaatttattttcacatagatttggagactggaaagtccaatatcaaagctctggaagaggtcaattcttggtgagggttctcttcctggtttgcacatggcaccttctcactgtctcatcacaaggaggagagagagcagcctctctggtgttccgtcttggaagagctcttaatcccatcaagaggactccaccttcacgacctcatctaaacctaattacctaccaaaggacccaactacaaataccaccacatagaaggttagggcgtcaacatctgaatcaagggaagtgggcacaatctagtccatagcacagcatctctctccccgcctctctctctagatgaataggcagatagacagatacatcaatatcctattgtttctgtttctctggagaaccctgaaccctacatctcttgcattttatcatctctgaaatccaaattccataatggcatcctctgaccaaatcagtccttcaaagtcattcacattttttttttttttttgagatggagtcttgctctgtagcccaggctggagtgcagtggcgccatctcagctcactgcaaccttcacctcccgagttcaagcaattctcctgactcaacctcccaaggagctgagctaacaggcgtgtgccaccacgcccggctaattttttgtatttttagtagagatggggtttcactgtgttagccaaggtggtcttgatctcctgacctcgtgatccacccgcctcggcctcccaaagtgctgtgattacaggcgtgagccaccgcgcccggcctcattcactttcttactgccattccagccgctcttcatcttcagcgagacctccaatccctaggccactttactttgtgcaaaatgatcaactgccatccagcttcagtccaccttcagctgggtactcaatgctgccatcgtcactttctcagaagttactccagattttcacctcactcttcaaatcactaaagtcatcaatggctttcattttgcccaaccaatcagtacttttctgttctcattttaagatttttttgcctttttactctattgattaccctgtgtcccttcacattacatttgcaataaatatattttaaacagtatgtgaagattacttttactacaatatgtgtgctacaagaatgccatggcactccatggccacttatcttacttggcactccagtgactaccacagtttctggtcagtagcagatggttcataaaatcttgttgaatgaataagccctctcatgaagaaacattctatgtagattgacaatgacagtcaaatgacagggtgaaagaaagggatttttattaatgtacaaagtggaggaaatactgaggccaaagtatttacttaagggtaattctgcctccttttatcttcaataagtggcagcaaagagttcattcagcctttacgaaagatgaagtggagatgccaaacactccgttccatcctacaaattgagcaaaggatccataagctttcgtgtagaatgaatcttgtaataaaagtaaccatctcatatttttaaaaatccattctcagcatgcgtgatgtctagagacacagcccgcttagtgggaggcttgacaggaaacagcagatctcaattgtagttctgattctggctaatttgctgtgctttctaagagaagttcgttaactttcttagaattcagtttcattacttgtgaaaacattggatttgattatttcgaaggtctctttgagctctaaatttctatgctagtctgatgagatttaaatttttaaaaaccttacttgttactcattctttaaaaatgtaaaaattaccatacagcactttttcttgccaaaaaaagtttctttgtcagcatttcaagatgcttagacataaagctttatacatcctaatgcaaaaaactgctaatttttcagtcacttaaatctttctagtcttcataaagactaggctgtattatttattattttagtgggactagtgatgaataatgtaaactaagtctttagagttgggatgcattttacctaagtttttcttcttaaattggatgttacagggatttatgctagattattatatgaaactaaaacaatgcaaatacaggtatataacatctattagcaccttgtatttataaaaaacttactggccgggcatagtgactcatgcctgtaatcccagcactttgggaggccgaggcgggcagatcacaagatcaggagatcaagaccatcctggctaacacggtgaaatcccgtctctactaaaaatacaaaaattagttgggtgtggtggcacgcacctgtagtcccagctactcaggaggctgaggcaggagaatcgcttgaacccaggaggcagaggttgcagtgagccgagatcatgccactgcactccagcctgggtgacagagcaagactccatctcaaaaaaaaaaaaaaaacaaaaacaaaaacaaaaaaaaactcattttgagaataatgtccattcactctacaattttaatcttctaaattgaggattaacattacaaccacaattaatacatggtgcatttcagcactgcatttcctttcagatctaaaagttgcacactataaaaaacaatcccaatacaaaaaagaattctaaaccttcatagacagaaagttattataagcaatatttaatagttatattttacaagtatgttgaaattaaaagtcagaacagaatatcaaatgtcacatttcataatcttgattcaactctcttagtcccttttcccccatttgtcaaataaagggcttagattcattgatttgagaaaaaatattttataactccatgaggagaggagggtaattaataaatgacatggaatttaagctagacctgaaatgcatagggttgtcacaggagaagaaagagaggcaggactcccaggcagaaagtccagctcacaagtaaaaagactagccaccaattggagaagttactggcaattcatgtaactaacaaatgaattagatacaataatatataaagaattcctactaattaataagaaaataggcaaaaaaagaaattttaaaaggatataaataattcagtgatgaagccaaatgctcaataaatgtatgaaaagataatttcatttttaagtagggaaatgaaaaagaatgcaatagtgaaaaacatatccatcggattaataaaacttaaaaatattttataatatcattgacgaggttgtggaaaaatagaaaacttgcacactttgatgaaaagataaatctattaaaaataccctggagggaaatagagcaatgtcccagtgaagctgtagatacgcacaacatttaaacttccaggtgcatactctcctagagaaacggagcacacgtgcataagcagacagatggtgggatattaaaatatggtgtttgtaatgtgaaacattggacacaggcctaacagctcatcagaaaaaaaagaatggataatgaactgtggtatactccatcaacagcttaatacacggcacttaaaaggaatgaatcagggatctacgcattaacatggtgaaaactcaaaaatagaatactgagcaaataaatgcaaattaaataataatacacatattctcatcatatttttaaaaacactgaaaatatacaaaatgttacattatatttatggataaattatacagtaatagttcaaatgtatatgtgaaattaataaatgctctaatgatatgaatgtatcaggatatgaatggagggaaggaaggtaaccagggaagggtagccaaggtacaatactttctgtaatattttatgactttaggccgagcatggtggctcatacctgtaataccagcactttgggaggctgaggcaggtggctcactttgagcccaggaatttgagaccagcctgggaaacgtagtgaaaccctgtctctacaaaaaaatacaaaacattagcgtggcgtggtggtgtgcacctgtagtcccagctactcaggaggctgaagtgggaggatcactcgagcctgggacatcaaggctgcagtgagccatgatcacagcactgcactccagcagggtgacagagtgagacattctctcaaaaacaaaaggagttgttacggtaaacactacatggttttcctcctacacgcctgtaaaatgtcacctttgattaataagcaaggatacaagggagtaacacttcgctgcatttaaaccaatcagtaaaagaagagataaagtcatttccattttgctgcgttcagaaaataattttcctaccaaaaataagactcttgtctaaaacaatactaacctggacaaaatgtggctggtggctccatgaatctaatagcaaagattagagattcctttgaaattgataaattatcaaatttatgtatgatgcttccacatttatgtttaggtaaaaaatggaaagacttttttaagagaaaaccaagggttaaaattgagttattctatagaaacatgttattttaaaacataacttgtaatcatttaaatagctgaatcccaacaattttaatttacaaaattatttatcttgtaagtaactatgattattttccctagacttccaactgcactttcaactagatgttcagatattagctagtgccaacgtttcgtatttataaaatcgcatgcactctgttgccatttagcgtagtgaatacccatttgtaaacaaagtggtgatacattatgatagccaaagggcaaagctttacctgaacagagattcatcatcttttaatgcagcacagcttgctacttgcaatatcatcaagcactctgaaaggttcttgtcagagattgatgacctaaacagtcactgaaacttaataacagcgttaacaactgcaggtcgatctcacacaccacaaaatagtgcttgtgtttttctccatgcttatttttagccaagttatatcaacattttgaccagagaaaatgttggaccaagttacaattttttattattccgtattagtaatcatagacggcatagaggttgctgtattagcagtaccacagcaaaaataattcacttgcaaagcaactacaaaacattatgcaacaattcattaatgggtttatccaggtagctttacattgactctgtgacacacggaaagcactaaatggaaatctagagagaaaataatatgatgctggccagtatgttttaatggtaattatgtccaaaaagtttatgaaatattttattcatgccactgctaacagatacctatgagataactgtatcaaaaaagatgattttctggttgtctttttctttttccagaaaatgttttgtttcctattatcaatttgatagtttgatgaaagcatattttgctggaaggtacctctactcgaactaaaaaaaaaagtccatgtatattttatgtcgctgatttcaataatttcactgagaagtattagaagtaatggtgtgactcctacgaaccaagcattattagttaaagacacaacttctgcaatgctccaaaagcaactgaactgtaaacaccatggatgattcacaatcagttcataacttactatttttatcctttttcagagctctgtgcatgtacataaaattcaagagcacaactgaataaaatacaaatcactgagtgactatttaaaatttaaattttgttgtgagcattatcaacaaaggcgggccattaaaaaggttatttctttaccggtgaattaatgatacaaggacaaccagtgtaaactattctgcagacaggccaataatgaaaacatagctaaagcagtaaagcttgccaactactgatgagactcaggagaaatttcttaacagatgtttccctgagcaaatatatactttgcctactctgattatgatggccttgagaattcgtgatttgattcaacactcagctactcttcagcagcctcataaaaatatgattcgtacaaaggatatattctatattttcccttcctaagaaccaatatctaacatatttatagttctcagtcccatatggtgaagcagtggtccaacagcactgtttataacagtataattaaggttgtgtcagcattttattatgaaaggaaggaggcgaagcctttttggatttttttctgttttcattttataagcttcccttagttgagtgcccactgactgcaataatctgctttgacctttcatttgcttcctgctaagattttttttgttttgtttttgtttttgtttttatttttgttttgagacggagtctcgctctgtagcccaggctggagagcagtggtgcgatccgggctactgcaacctccgcctcccaggttcaagcgattctcccacctcagcctctggagtagctgggactacgggcgcccgccactatgcccggctaatttttgtatttttagtaaagacggggtttcaccatgttggccagtctggtctccatctcctgagctcaggtgattggcccaactcggcctcccaaagtgctaggattacaggcgtgagccaccgcacctggccgaaagagacaaaaaaaaaaaaaaaaaagcaaagcaaaacaaaaaaacaggaaattgttcctgatagatactttaaccttgcaggttcatgtctaatcattattatattctgcagatttctttctttctttcttctttttttttttttttttttttttttttttttgaggcgaagtcttactctgttttccaggctagagtgcagagtgcagtggcgcagtctcggctccctgcaacctccgcctcccaagttcaagtgattctcctgcctcagcctcccaaatagctaggattacaggtatgcaccatgatgcccggctaattttttgtatttttagtagagacggggtctcaccatgttggccagcctggtctcgaacacctgacctcaagcgatctgcctgcctcagtctcccaaagggctgggattacaggcatgcgccactgtagccggccaagacttctttctagaaggaacatgagcaggaaaatattggggaggtttgtgatagcaataaatgtatacagagaagagtgagggggtcacaattgttgagtctcattataatgcctatcttgggcatctctgcatttttactaatatctatttgtgtgtattaaagccctagtagttttaatcctttctttctaaaaatcttccattgtctaattttgtatgcaatgagaaatattaaaatatgcacttactagttgtgggactttgggcaatttgtttaattgcgcctcaacctcaaattccctgagtattgaatgtagatagtaagaatatctacttcatcagactgcacggaaattaatcatgcatgtgttcatgctcagtgcctggcataggattttcacccatatcctctccatccttacctactatggctccattttagttaccaccaaggtctccccattctgcagctgcctggcttaaagtgcgggtatcgaactctctacccaaagccaatcctttttaaacattctgaactgttcttttttctttgtattctaacacaagctacaaattaaccacatcatggttaatttgatgaatacattatcctctaagattaataaattatcctctaggctctatgaaggggaaagaccaagtctattttactgacacggtgcctcatgcctggcatagaggtatgtgtttcataaaatattagtctttagctatcaaatagttacgacattatgcacagttacacaactacttaaatgagaataattcatctttgaaactaaattcaatttctgataaggcttgtaagtgaaaaaaacaaactggttctgattttttttatcttaacagcttttacatgagtcatattagaacactccactttcttttccttttttttttttaatgcagagacagtgtctctctatgttgcccaggctggtcttgaactcctaagctcaagcaatcctgctgcctcagcctcccaaagtgctgggattgcaggtgtgagccgccgtgcccagccaatactcacactaaaactgagagacatgtactgttactatcaagatgtactaatcaagttgcctaaacacagtgaatggcagaaaacctaaaatccgagaaaccttgagccaaagaagaattcagcacacctctctacactgccttgtcatagcttggatgtgttactaaatgccttttattgctaaaccaaaattgtccccacccctgctcactcctaatttatatctgcaggatctccaacactacagtggcatctcttttccagctctttttaaaagaataattgcgtttgcataattaaaaagaagaggtatctggctgactaatattttccacttatattttgaatattatgcatttttaggtcacctaaaaatatgaaccaacaatttcttgtacaatttactgagagtccagtgatgatttggctgtacccaaaatttatcaatggcaaataaccaacggaacaacctttcaccagaatgttgcaatcactagcacatattctaggctttattaatcaggtattttttttcatttgtattctcaaatttgacaggcaacagattcaataacataacctctagaaaactagcattagtacattgttatcccagaatctaaatatttcattgtgtcctgatagacaagaacattcaggtctttcaagtcaaggatttccctcttaccaagagataattcacatgtgccatcctccctcaccaattgtaacattctcagaggtggaaagctgccagagtcattaaccggctctgcattatgccatttctcttgctgtctaacctgtcacctccatgccttctgcagtctttcctctccttcagactcgctctcagacatacgtatcagtaactggtgcctcgccttcctcccgccgcctaacaggctgctattctgccatcgccctcctgggagcgctgctggaccgtgagcccgctctggatgtttcccgctgagttcctgccaatctccaaccagcccaggttggagctgttagagcaagagtgtctgcttttaaccagtgccataggccatggattttacttctgattctaaacgacagcttgtttatataagatacaaacgttgggcaccctaaaggtagctaagttcttttttctagatggtagttttgcaaagaacatacattatcaatgcaaacctattagtcttagctcttcgttatacaggacaaagtaagcctcctttttgactaaattttattaaaacgttgttgcttttttgccttttaattcataatattttaaatacacatgaaatagtaaagagtttattaattctatcatataattatgtattaataaaagtttacatctgcatttcactgcatgagaagtcctcatagtaaatattgtcctaaatatctaaatacatgttttttaacatttacatagccaatgagcattgtgtagctttaaaaaggttccttttgataacttccatcagcgatactgtgaagcacttaatagtgtctctgtcacgtcttttccttttcttcctagtaacacacagtttctaaatttgcttcttttacatatcatatttatttacagcaaaacattttcattttaaatacttttaaatgtaaatatggtttctgttgtccacatggtatctgtgatacaaatgagctagttgaagtaatcaagaaaacatctgttaaaagaataaatattctttcataaatgtgctatgtattatcatgactatctattgctatggaagtgcaaaaagcagactaacatttccaaaacataaataggataatgtcacatccttgctaaaatcttccagtgacttcctattgaaattaaaagtgtgtaaaattttgcatggtttacattgtggacgtgatatgcccctctgaccccactctccagcctcttcttgctgtgtcctgcgttccttttccctgccctgcacccaactcctaagctctcactgcgatgcacttcctccagttccttcaacagtataaggctgcgtgcacctgctctgcctcggccttgcacagtttcctttatctagaatgccttccccgccctttcttggccaaccactcccctcctttcaggtctcagcttaaatgtcatttcatcagagtcccattctgactttccctccactgccgtctctcataacaccctctgctgctctgtcacagcacctgtcacatttgtgggatttggtaggcatttgtgtgagtagatgtctctcatttccactaaagttgaagtggggaccatagcttactgtaaaaatttggcttgtagacaatggctaattaggctcataatggccctctgctaactttttggctctatttttctcatatgtaaagtgtgatgatggttcagtgagtatatgtacatattgtttttatatacacatttttatatatgacatatatacacatttttatatatgacatatatacacatagtgtatatctttggaaaaattacgtttagtaatgatactgtgaaacacttcatggtgcctatcacatatcttgtcacatactgtgtgtatataatatgtatatgagaatatatataaatatacatgcatcatttataaaaggaccatagtaattattacgcaagtgcttacttacatggtattttgttcattaccaaatgtccaatggctaccacatagtaaccttcaaaaagtatcattatctgaattcgtgagtgaaaatattttccttgtccttataggaaactagataccaaacatttccagtccactgggacaaacatcttaattttcttgagagttgtggaataagaatagcagtgagaacaagtggaatggggaatgcagaggacagacctttgaaatccgtttctgttctcccttgccattctcttctaaacttcagggttcaaggcaaatctggtatataatcaggttatgatctatgatggctatttaatgcacttatttatcaaatatcttttgactacccactatgttctaagcatgattctgtcagagatataaaagagaatgaaacccacaaaaattcctgcctttgcagaacacgccttcagtaacagtggaaattgaatgagacacctttagcttattcccatcactttgtggatttctaaagtaaatgtgatggaatatcttgaaacccctccctggaaaatttcagacctatttagtcaaggctcctaaaggactctggaacttcagagctgaggtctggaagtacagtcatagaggatctaactgaattaatgaagcatttcccaaagcgtacactgtagtgatgggtgttacctcaaaatgcacagtccatggacaagtatgaagaacaatggtttaaaaaagaagctttttgataattattattacaggttttcttgctttgttgtgattcactttatgttaactctgggactttctcactaatatatctatttaaataccagttcagtcttttcctactgtgtgcacttgggcaaattactaaaccttcctctgtttcagtttccccatctataaaatgggaattataacagtttttcctcataaaattattcaggattgtatgagtccatacatgtaaattgtttagtacagaacttggcacatggtaagtacttaataaatgttaattttattattattatttgtttattcatatttatttatttatttgttggagacaggatctcttgctctgtagcctaagctggagtgcagtggtgcaatcgtaggtcactgcagtcttgagcccctgagctcaagcaatcctcccgcctcagcctcctgagtatctgggactacaggtgcatgctgtcatatccagctaatttttaaattttttgtagaaacaaggtctcactctgctatccgtgcttaaactcctggcctcaagtgatcctcctgtcttggcctcccaaagttctgggattacaggtttaagccacagtccctggccaacatttgttagatgtgtcctgattacactgataaagactttattacagaacttgatttctatagaatatccttgagagatattgaacttcatcaggacattaaactttctgaaaaagccaatgaggtccattctggcaacttcaaaaaggaagcctaggtcaagagattcagtcaaatcagcctttgtaaggaaggcaagtgggagagaatcagtcacccacactacagcagagtgtgagggccactatagtaacaggaaaatcctgctctaatccagacaaacacaatgacattatagtaaaatgtacttgcacatattatgtggcaaatgtcggcacaggctgtctacatttaagtctaagggatctaatattacccataagatctcttatgggtaatattccaaaagttgtgaatataaaaatataaatgcagatagaatctttacagtgaatgtcattaacccataacgtggtttctatatataattaatgaatttaaagtgaatactccacatctatatgacatttaaagcaattattctcatctccttcccaaggaactcatttaaattccttactcccaaatctccgtcctatgaactttaacttacaaatgagccaccaagtataacataaaaattttgcaggttgctatggcttgaatgtttgttccctccaaaactcatgttaaaattcaattgctattgtaagagtgttatgatgtaggaccttcaagaagtgattaggccatgaagcctccactcttagaggtgggatcagtgcctttataaaagaaagaatatggccccctcttactctcttgccctctcttgcctttctgccacctgccatgacatgacacagcaagaaggcccttgccagaagccagttcctcaatcttggacttcccagtctccaggatcataagccaatgatgattttattaattataaattacccaatctcaggtattctgttatagcagcacaaatggactaaaacacagacagaaaagatgtagataaagttttatgtctttcattttcttattttctgtaccaaatcattataatagccagtgtagatgagaaaaaagaatcaaaggtgtaaatgagtttgagaatagaagtcagataaggaatccggaatccagaaccacaaacattaggaatcaaaacaagagaagtaagaatacaaaagcaatagagatgaaggcttggttatgtgtttttatagggtttggaaaagacagcacagattgatagcttgtgcctgctttaacttgtcatacaccctgtctttccctatgtggtctggggtatataagtccccctgtaaacttgtgcttaggctctgccaacactacgacatctcagaccaaccttagggattcataaccaaagatgaactacatcctatctgaataaggaagaacattacagggctgtggctggaaatattcaaacctctctatgatcagttattgacagtgatttctttctcctgctcttctatactctttacacgtattagaagcttatgagtagatctttgggatatttgtgagtcttgtcaaatcattgcgctaactttgctgaagcatttttctccattgctaatttcaaaagcaaaatcaggcgattgaaagaaataaaggcgatttgaataggaagagaggaagtcaaactttcccagtttgcagatgatatgatcctatatctagaaaactccattgtctcagcccaaaagcttcttaagctgataagcaacttcggcaaagtctcaggatacaaactcgatgtgcaaatgtttagctcttttggttctcaagttcttttgtcccagaaatgcaaattatagttatgtaccccttagatctaaattctactgcaacaaaaaccagatacctcttctggttcattataacaatattttgtatctgtcatattctgtaactgtagttggggtcagatggttgttagttttgtgatatcattggaagtactacctattttcaataaatcagacagtatgagaaataacatttaaaactttgcaccatattctattaaggttatcacttctgaagattaatatatattgttcagagagatttgggaatggagtgaatctccgagatgctccatcagatgtgaagatgtattctccctgtgaagccattgttattcatgaccccacacatgcttacaaaagcagttagaggacttcaccttgaaaaggtgttcttaagtgccaactgttcttacacaaaaggccagacaagagttgaaaactcgactctaatatgtagccactttattttccttattgcctagatggaagagattcttctctcattaatgcttgaggaataaatatttttaggcaagaattaaaggggctaaagtattaaataataaaaaacttgcaagcataagttaaaatataaaatttaacaaaataatttaccacacaatgaaaacctctaaataagatatcagaaaggtattttttaaaaacagcttcttctcttatcttagcctttcccctttaattgacttctttttcaagtaatcagtaagtccttgcttggaagagataaacaagtataaataaaacaaacacaatgcaagttagtttatgtatatacacttttgaatcagatagcattgccagccaattgagctttctcctgtggtttctgtggggtcgatatttttcatgctgtgtatgtgcatttatcttccagttgatcttccataataaaatgaatcccccaaagcttcaaagccaattagcttagagttatatttttcattttttccttatgaacttcttcttcattgaaaatacagtactgataaaaacaacaaaatacaaaaaagggaaagagatatgcttacaccagaatctatattaacaaatctgtcatatcagccattctgttgcttagcagtcatgagtaggtcacgtggccagcatcctcagtttggcccagttttctcaaagagaagacatgatgctttcttactcggagtgaactgggtcttccataccatcctgttaaaaaagtcagctaggtcttgctatgtctaaaatacagatatattaataagtcatatacaattattgattaattgacgataatataaggctttattagaaaagaaaaatgcattaccataatgtgtacaactcaatatcaaaatcactttggacatgaactagctgccatttattttcatgatttaagaatattaaacaaaagaggacaataagtatcataaacttcattctgggggaatcagaatcatcctctttatgagttttatgaggtatgatatataaatacacattatgagaattgagccaaatgtttactgcttacaactctcattaacaacacatctgtccataggtttccttgttcctgatctaaacgtggcagttctcactgttgggccctgttaaatattgtcgactagtttgttcaacctagattccaacgcatctctaactgagatctggggaaactaaacaacatttatctattgctctagggtccttgatacacatcagattcctcagattaaatgcatttgagtgagatgtggaaagtgaaagtcaagccaaaaccattttcttgtcttttttcgatgttttttctaaaaagaatatggaaatttgaagattttctgcttcaatcattgaatgtctttttctttgcttcttttgctttcacgggaagttctgtcagaggcagcagtggcatcagcctcggattcctcatcctgcgtcacagacactctcaagcgcagcagctgtctcagtagagcaggtcccctgtggatcttgattgaagaagtcatttctggtggcgcaactacaatctatccttccagtattccttaatggaagcctagaattttctgtgtgttttttgtttgtcttttatattttctcttttttaaatattctttttttcccttttttttttttttttgagacggaacctcgctctgttacccaggctggagtgcagtggcacaatctcagctcactgcaacctccatctcccaggttcaagcatttctcctgcctcagcacccccagtagctgggattacaggcacgtgccaccatgcccagctagtttttgtatttttagtagagacaggattttgccatgttggccaggccagtctcgaactcctgacctcagatgatccacccacctcagcttcccaaagtgttgggattacaggcatgagccactgcaccctgcctttttatacttgcattttaagttcaggggtacatgtgcaggtttgttacataggtaaacatgtgtcacgggggtttttgaacagattatttcattacccaggtttattctatgtatttattattattgttattattttagatggagtcttactctgttgcccaggctggagtgcagtggcttgatgtgggctcactacaacctctgcctcccaggttcaagtgattctcctgtctcagcctcccgagtagctgggattacaggcacccaccaccatgcctggctaatttgtgtatttttaatagagacagggtttcaccatgttggccaggctggtcacgaacatcactcaggtattaagtctaatactcgttagttattcttcctgatcctctccctcttcccaccctgcatcctctgaaaggccccagtttgtgttgctcccctctaagtgtccatgtgttctcataaactagctcccacttacaagtgagaacatgcagtgtttggttttgtgctcctgcattattttgctaagattaatggcctccagctccatccatgtccctgcaaaggacatgatcttgttctttttatggctgcatagtattccatggtgtatgtgtaccacattttctttatccagtctaccactgatggacatttaggttgactctgtctctgctattatgaatagtgctgcagtgaacatatgcttgcatgtgtcttggtaatagaacgatcgatttatattcctttgggtatctacccagaaatgggattgctgagtcaaatggtatttctgtctttaggtctttgaggaattgccacacgtcttccactatggttgaactaatttacatacccaccaacagtgtttaaacattcctttttctccacaaacttgccagcttctgttactttttgactttttaataacagtcattctgacccattccgagccattctgactggtgtgagatagtatctcattgtggttttgattcgcatttctctaatgatcagtgatgctgagctttttctcatatgattgttggccacatgtatgtcttcttttgaaaagtgtcttttcatgtcctttgcccactttttaacgcggttgttttaatggggttgttcgtttaagttccttatagagctgaacatcagatctttgttggatgcatagttggcaaaattttctcctcttctgtaggttgtctatttattctgttgatagtttcttttgctgtgcagaagctctttagtttaattagatactattggtcaatttttgcttttgttgcaatcgattttggcatctttgtcatgaaatctttgcccatgcctctctcctgaatggtactgcctaggttgccttttagggtttttatagtttggggtttacgtttaattctttaatccatcactagttagtttttgtatacagtgtaaagaaggggtccagtttcagtcttctgcatatggctagccagttattgaaccaccacttatgaatagggaatccattccccttttcttgtttttgtcaggtttctcaaagaacagatagttgtacgtgtggggccttatttctgggttctctattctgttttactagtctatgtgtctgttcttgtaccagtaccatgctgttttgattactgtggccctgcagtatagtttgaagttaaatagcataatgcctccagctttgctctttttgcttaggattgccttggctattttagctcttttttgattctatatgaattttaaaatagtgttttctagttctgtgaagaatgtcaatggtaatttaatgtgaatagcattgaatctataaattgctttgggcagtatgggcactttaatgatattgatttttcctatccatgagcatggaatatttctccatttgtttgtgtcatctctgattactttgagcagtggtttgtacttccccttttagagatctttcatctccctagttagctgtattcctaggtattttattcttttcatggctattgtgaaagagttggttcctgaattggctcttggcttaactgttgttggtgtataggagtgctagcaatttttgcacatcgagtttgtatcctgagactttgccgaagttgcttatcagcataagaagcttttgggctgagacaatggagttttctagatataggatcatatcatctgcaaacagggaaagtttgacttcctctcttcctattcaaatcccctttatttctttcaatcgcctgattgcgctggccataacttccaatactaggttgaatcaagtggtgagagaaggcaatcttgtcctgtgccagattacaaggggaatgcttccagtttctgcccattcagtatgatattggctgtgggtttgtcatatatggctcttattattttgaggtacgttccttcaatgcctagtttattgagagtttttaacatgaagggatgttaaattttatcacaagtcttttctgcatctattgagataatcttgttgtttttgtctttagttctgtttatgtaatgaatcacatctattgatttgtttgttgattgtgtgttgaaccaatcttgcatcccagggatgaaggctacttgattgtggtggataagctttttgatgtgttgctagattcagtttgccagtattttgttgaggatttttgtattaatattcatctaggatattggcctgaagttttcttttctttttttgtatctctgtcaggtattgggtttgacagtagaccctgtttttacattgagttctgactgatacagtaggattagaagcagttgtacttgagagatgggaatttgggagtgattgtgagacctgttttgtgaaaaaaggatgatccctatgtcattcaaaaatggaaaatgtgtggcccatgacacagagccactcataggatcaccttcagtcacttgaaataaagtgcctactgaagggaaggttttgaaatgaaatgaccattgtgatacagcatccaggagagtaaaaagaatacagaactctggctatttctcattatattgggcaatttttaaataaaaaaagacaggctctgggctttcaattcttagttcaacacacagttacaaggttgggaaacatctatcatgatctcctgctgtcacataaccaacatagccagaaatcagacacagagtttgatgtccataatttgctgtatcacaacaaaaactgaatgcaaagcctttccatgcctcttacatcaaagctggagtatttcccaacagaaagtggaatcctgatgaggaacattttggtggattctgttgaacctgaacactctgcatccctgaagaccagtgaatatctcttcacccacagaaacggttctttctctcctttgtgatggaacaagccctggtttgtttggagaccctggccacagctgcacctcatagacactacacctatgacaagagttagatcccagcttgtcctagggaaacgaacagaatctgacatggaaagagttatgtttcatatcaaatagatccatgattttgctaatatatatatatatatatggatatacatatatgtatacgtatacatatatacatatgtatatccatatatatacatatataatgttagctggaagctgaaggatatgtgtgagaatgggttctaacaaggatagacaagggaaaaagaaatatagatcagacaaaatgtatcaatataggtatacctaccagagattatagactcaatgtgccagctgaagcttctcactgtggtataaaatgttgacttggttagttgcctggaacctggactaaatggtgttctgcacaaaacgaaggtgacatgcctaaccttatttagtataatacagaaaagggaattttaagacttagataaaaatggaatgagtttattttatgtactaaattactcaatctatagaaatttatcctgaggtgcctcagaggacccttcatttacctaggcaatttaaaaataaattggtaaacaaaataattaaagacagaaatatggaccaggcctagtggctcatgcctgtaatcccaacaattgaagaggccatgcaggtggatcatttgagacaaggagttcaagaccagcctgggcgacacagtgagacactaataagatattagctgggtgtggggtttgcacttgtagtcctagctatttgggaggctgagatggaaggatcgcttgacctgggcttttgaggatgcggtgagctgagatcgcaccactgcactacagactgggtgacagagtgacaccgtgcctcaaaaaaagaaaaaataaaatagaagacagaaatatgtaataaaccactagggggaaaatagaaaactatgagtttataccaaaatatatatctctatgtgtacttatatgcaaaatacttatacctagatatacaaaatacataaataaataaagtaaataaataagaagataggggcttttgttttagaagaacaccaactgctgaatgataaacatcagagggatggtggagttggaaaaaggtcatcatttttgcagtcattacagtaaagattgagacaggcagaaatcatcaactgatgctaaaactaggaggataaatgtttaaaagaggcaaaatatttgcgtgatcttaaattgttttactacagattattaattgcaatgtaaaaagcagtaactatatggtatacaaatcaaatgccttgaccagatgataaggatgcaaatagacattgtgtgactctcgatttgataccctgagaaggacatcaaatcacaatatcccttatgtagtatcccagttgggaagacatgactgaaatctaaacatgggtaaacatcaaactcaaaatgaggaacatgcagttttattttttgaaaatgtgggagaggactatattctgcatataaaggaggcaaagaaaggctttagacatctttcaaattaaatgaatctaaaaagacataattaagtgcagtacctacccctagactacattttataatggaagacaaattcagtgaaggacataactgggttgcttgataaaatagaatgtagatgatagattaaaatacgagttagtattacatttactgaaggtgataaccacacagttgttacacaaggatacattttttcttaagaaataagtacttagtgaggaagtaccaggaggtatgcatcttatgctcagatgctgaggcagagacagggtctctatgataaagcaaatggagcaacatgttaagaagtgaatctgggtaaaggctgtaccattgttctttgtatacgcctatttttgcaactttgctataagtttgaaattattttcagataaattaaaaatatatgttaatacaaatatacatataacaccttgaaaggtaccatactggatatcctgagtaggtcagcaaggaaggtggaaaaggctgtccttgacataggcttaatgacttcagtgaagacaactgggtcccagagtggagaagactaaatggcagcacttaactgctagaaacaagatactcatgattacagaaataggcagcagagacagaaaggtcatcagaataatttttcccatagggatctttggtagttactaattaactatggggtctcttggacgaaaatagttaggcaggctactagagtcctattagatctgaatttagagactctagtattgtaagcagaagtctgattttgccatcataaaagagtaaaagactctgccttctaattcttagacataaactacttctgaacgccaaaagtccctcaaatacagagtaaaacagattccttaaggaaacactttttgatattgccaaatcttttctctggtctccctgcaaaggacgcagagccccttaccatgggcctgaaaaaggaaatgcccaggcctttcagggattactgagcttggactaatgcatggggtcgtaaggtccccagtatattgcatatctgtcttctctgcccaagtttagagtcatttgagatatagacaatagacattaaagaacattttgcatatcaattaatataattggagaattgttgtcggatatggtcaagtaggttagggaactcatcattccaggttcccaaccccagagatacctgggcggcagcataacctcccctcaagcacatatgttattacattacagtggtctaattaacagcccgattggagtctattacttcagttgtctaaaggttttgagacagccaggtgggaacggctccctggcaaaactccatctggcctgagcacgggtgaagccacagaagttcacgccatttgcagtggaacggagcctggccctttctctttggaacctgggattcaaactgcgaggtaggaagctcaccagcagggactctggctttgcagagggtccctgttttcccttttatcccttttcatccaataaaaccctgccttactcacccttcaattttctgcagacctaaatttccatgaccatgtggcaaggaccctgtctttagctgaactaaggaaaagtcctgcaacattttgagactaaattcaagtgactattttatgacctgcttggccacttggccttttaactatgaattgctgagtaaataaattgtccagacatggcatgatagccattcgaatggctcactgaatttttttttaaaaagctacagaattgatattaaagcaacaaatgggcaatatttacctgtggaaggctgcaaattctgtttcatttttgggccagggaatacgtgaggagctatgaatcatgttaaagatataaagggattactgataaggcctaaatttttttcaacctaacagctgtgcagaaaaattttcataatgcttgcatttaattacataaagagtggtacagtctctttcactttatctcagtaatgaaggcttgattctgaagataatccagggtctttccctgtcaaggccagcatgtgggtaacagtgaattcaattcccactcttcactatccttagacgataaaacaagaataatttttcacatgcattataaagatgaaaaatagtaccgtagggcgtattttctttaatgtactctaaaaatatagagaggtagcatgatagacagatgtataaaagaaaaaaaaattagcctctgagccatttctagagttcactgtaacaccattcaacaaaaattaaagaatatgaaagagtcctttccttaaaaaaaagaaacagtagtttgttaaattttctagtactgaagcttctttgtgtgggatttagccacagcctctgatggcttgcaagattgctagttttatggaaataattaggaagcccagctctgccttgtaaactaggagtcttgaggttaattaaagtaaaatgaatgctgcatatataagaaccaccagtaaagcttgacagtcaggtatgtagaattctgtcatctgctgagaatacagacaaagaaagccagcatcgtaaattaactgggaatatgtttagactttttataataatcttcaatcaaccttgacatcagacacatgtcgatggcatatagttgtacactacagtgattttattcacagtatatagacatttccaaaatatttctatggattcctaatatatggtgaatatttttctctatttttttaaaagagagatagatgtaaaactttttgcacaggctcattgatttcattaaagatgtcaaaggtcagctaatttagttggccacctctaacgaaaattatatttcataaatggcttatttccaaaaatcattcaaaaagatggtagtgctacccccaaaacagtgcaaacatcctatctctgggaaggaacaagaatcaggagacttgggtttagagccagaatctgcctcttcaaaggagagtgaactgagcaagtctcctaaactttctgagcccgtttttaaaatatgaaatagatacaaaaagcagtagcttgttgacttcgtgaagtttttatgaggataaaataagaaatacaaatgcattttctactgtaaagcactatgtacatgttagaaatttattaaagaaaacatattccctttttttaaaaataagtaagttttctattaatttgttatatggaagcagctttgttggaggcaaggagttgtctctttacaaatgccggaagttatagccctctgccagacagttcaaagttcacaataatgaacagacagaataacacgtgagatttcatagacaaactaacctaaagtagaaagttacgtaagtcagagatggatgagtgtatgaaatgtccatagaaagtgctatttgtgccatatatagataggtaagacatgggcacaactgaaaaaatataatctcaatcatagttatttgaaagatttcagaaaatatttaatcaaattaaatgaatattagtttgcagcagagttttaatagttaacatagctaacctagagtaaatagaagtctaaagaatattaattctgcatttaagtgccctgggaagtttcctatatggcagtgaaaacgcaatataccattctgggatgtcaaaatgcagaaataaggtaaaataatattacactagcattgtgtatctatccattctgaaataagcattgagggaggaatgtgagggtttaagagtatgaactttacagcatggatttgtaacatcactattgacagatcacaagcattgttttccttaattcctagtctagtatattctaaccaatgtctacttaagtgaagcacatacattctatgtttatactgtgaaaacacatacaatttaaaagctgttggaaccctcaaaactctttaggccttgagagaaatgtgactgtgatgtgaatcacatagaatgtagttacaacttctgcttcttagattgtagaataactctctcattgctcttgcgttgtaaatgactaggagaaaccagagaccacatctcttccccttctaatcactgacttttgttatagattaactgcctcctttactgtcctgtacctcattcagaccagatcatgcaaaagacctcatgactgtcacatgttcaatgtggaaattaaatatacctttcctgaaagaaaaagaccagctcaaccaatcagatctttgtaaccatgcattaagccatatatacaaagatgctgaaattctgttaagcttccctaaatgttatctatatagatgacctccaaaattccacattttggaaagctgatttccgttttttggaatccttgcttcccagatggccatcctcaagcttagtgcttgaataaactctacaattaataaagttttctgaatctcattatttatggttgtcaatactgaacacacaaatgcataagcacatccacacacacttcttaatcagataagagaattaatttgatttttcacggttgaattcactctgctctccaagtggttgcctttctcatataaatttgaaccaaaatggctatgtccaagatagtgtagtaccaggttacattaatccctgtctggataatactataaccaattaggactccaagtaatttgagagtttctcattaaaaaaaacttcaataatttcattgagctcattataatagatctaaaaactgaatgaatcagtatattttagcagaaagcatcagcgtacagaattaacaatagcctgaagcataaagacatgattttttttatcatattacaaatgtaatgacccaatgggttcaccttgcccactgcctagacagagccaatttatcaagacaggggaattgcaataaagaaagagtaattcatgcagagccagctgtgcaggaaactggagtcttattattactcaaatcagtctccccgagggttcgggggatcagggtttttaaggacaacttagtgggcggggggaagccaatgagacaggtgtgctgattggtcaagtcagagatgcttcttgtgcttagtcagttcctaggtgggggccacaagatcagatgagccagtttatcaattttggtggtgccagctgatccatcagttgcaaggtctgcaaaatatctcaagcattgatcttacaagcaggttaaggagggtcagaatcttgtagcctccagctgcatgactcttaaaccataatttctaatcttgtggctaatatgttcaacctacaatggcagtctagtccccaggcaagaaggggatttgccttggtaaaggcctgttatcatctttgttttaaactataaactaagttcttccagaagttagttcagcctatgcccaggaaagaataaggatagcttggagattagaagcaagatgcagttggttaggtcaaatctctttcactgtcttagttacaatttcgcaatggtggtttgacaagcaggctagagataggtggttatgatatagaagggctgggctcccagctaaaccccaaccttaagcctggaaccgcagccctaagtgaaaatagctgaatccatttttccgcaaaaatgtttttttgtttgttttttttttttttggtctgccttacccctatcctgtgcccataaaaagtcttcagctggcagagcaacacaagcagctgagcatcagggatacaagtggctgagcaacgagcatggaagtagctgagaaacaagcagagaagcaactgagcttcagagactgcagatagatgcaactaacttcagatggtgcagcttcagggaaagatcaccttcttcccacaccatcccctttccaactctctattctgctgagagccacttccatcacccaataaaatcctctgcatacactacccttcaacccattcatgtgacctgattcttcctggacactggatgagaacctgggtgctgagagggcaggggctgggacactgctgtggggtctgcacagagccttctcctgccagagaggagcaaccagccggttccagtattcatttgctttggtcccacactcacttgcttgcatgctccctcttgcaaggagtggccagcagcagactgagtgaaatgagccatccagttcccacccatgaaggggatcaaggtcaaggaaacaatctcatctcagttgtagagtcaattcaacagcacaacagtggcagaatgttagcccaacatcactttgaatcattttggctttctttcttggtcaaaagaggactgccaaagaggcaaaacacaacttcacataactaaatcccaagcaagaaagaactgttgaaagaaaatccttagacaaatataatttaacagagtttaactgagcaaagaacaagtcatgaattgggcatcctcctgagccagagtagactcagagagtccagcacaagcatgtggtgacataagacttatggacagaatgaaagtgacctacagaaaatggaagtgaggtacagaaacagccaggtgggttatagctcagcatttgccttatttaaaaatggtttaaacagttggccccctatgattggccaaaactcagtgattggcacaagagtagatttgagaccatttacacttctatttaggttatagttcactatgtacatagaaagctttaggctcaatttaaaatatgtaaagaggcaactttaggctaaacttcacttaacagaatggagtggaagcaaacacatatattcctttatatatgtttgcctttaaaagaggagtaaaatccttctcagaaatctacctggtcatttccccttaggtttcatcttccagaactgagtgacatgcctactctagacaaatcactaggaaagacaaatgagattgccaaaactggctttgacctgccatgtttcatccatagaagttctattgtcaaccaaacataatggggattctgttaacaagagagaaagggaatgactttgaacaggcaattagcagagtctacctccagggatagcctcactccaagactggtctgagctctgactgaagtgtatgtaaaaacaagagtatatttaagaataaagatgggtcagcaaacatttttctgtaaagggccagatagcaaatattttaggcttttcaggctatgtaatctctgttacatattcttctttgttatttttacggcatgttaaaaaaaatgcgcaaaacactcttagctttcctggcatataaaaactggtcatggaccagatttgaccctactgtgccagcacctagacagacacatgatataatcattgcctttcatgcagttagttaacaaaaatatatggagtgtctaatatggtcagtcaccaaactaagtgttggggatgcagacctgaccaacgtagagtgtattccctgagaaagctcataatgtagtggtatctcctgcctccccacccaagaaaagccaaaatgtaagcctacctttcatttttatgcagtaaatatcctaaacagtttttctgcaagtgtggtatataattttacagatatagatttttaaatagtacaaagttatttacaaagttattaagctgagaaaatcacaagtttctaaaaaattacacatatttgaggcatgtatgtcctacctacaaggaatatatatgaaggatacaaagtagccaaaacagtataaaaataccctacgatattgatgtaatttctagccctggtactatttcctctgtcaaaaaaacacacaacaaatatatatatgtgtatatatatattatattatatgtattatgtataaatataatatattatatgtataaatatgctatttatacatatatgtatatataatacataatatatgtattatatcttataaaatacgtatcctgaaacctaatatcatgagttttaaaacagtagttgtcaaaagaaaaaaatttgtatactaaacataatagaacccaagattgtctgctgtaagtaaatttcatccaattcttaatgtaagagattaacattttattataggaatttcagcaattttagagggattttgtaaaatcagtatggaaaatagacattctttaggaaaaaaaaaagcatttaatcagaatcaatctgactgtgtcagtgtttgaggagtatttgagcctgatttaaaaagtctttaccagtcttacctagaatacctccttgtacttaagagatattctcaatccactgccttgaggccatcagaggatcattcagttgcttgttcttttcttctttttcatgttgactaaagaggcacactaagcagtccttctaagcaaaacaaaacaaaacaacaaaaaataatcaccaacgcatttctgaaaaagaatcaaactgtcctttggaaaactgaaattgcacttgggaactgcgtgtttctgtctttaaatgtagtcaacaaaattgttgctctcttagaaatggtttgtttgtgataagtgagctttctttctgtagatgaagtccccagagtaagtttctgtcaccaacatttccctttcttggacttgagaaattacagtctgcagataacatacttgcctaagcagcagaaaaatgttcctgacttcatggaacttctgaacagctttgggaaatagtattccatgaaactccctggggaatgccccagaatgtctatggggaccctaatcctctgcagatgcacattaaaatttgcagcaggtttctcaacgggcctttctggtgtttttgtgctgaggaagtttaagtctgtctttggttctaaatatcaaaaaagtgctaaagtatgaagtatttatcataaaatcttctgaacaaacatgatttgatagatcggctctaaaaacatgtacaactttaatagaagcagcaggccggagtcattgaaaagattagggctctccagtcaaaagatctggtttaaatctaactgctgttgcttatcatctctgtgaccttgtacaataatccttaattcatctttctttcctcatctgtctaatagaaataatgtgagcatcaaatatgatagtactttcattcattctgtgattaagtgaatatttgttgaatcaggcattatgtgtcaggctctaaactgaaaaggagcagagaccccctcttaggggcctgcacctctccacacccaagcatggaactaaagggaaatcttgagttctttcaagggaaattccaggtgcctagccagccctgagaaataaataagtaacttgaaaagcaagaaagtaatagtagcccaaaacaacagccaagaaagcttcaatcatgggatgtttgattctcctgcagaaactaaagataacaacataggtctctgagttgtttttcagaaacccagacccccaccaaacgaacttgctggcatgtagacctcagataacgaggaactgaagtctgaactctgaccactgttctttgttttacatttcattctgaggcgccaggagggagtcacatccaggagccaagctaacattcaaatctgctgaccccaaatttttacacaaggtttatcttacttatctaattgcaaattagaaaatctttgaatctatttatgacacgtaagccctctctcccttaaagttatctgtcttcttaaggccaaaaccaatgcaaatgtatcgacataccatgttgcctataacttctgctttcctgaaatttacccctgcctttaaaaactctcacctgcaatccatcaacaaggctgtgacttaagcgtgaactgtctggtcctcattgcttgctgccctacagataaacaccttcctttctactgatgcaaactgtggtgtggatatctggtcttactgtgctggacaagaggaccccagtttggttctgtaacaggactagctgctgggatacacaataggaagacagccatagtccagtcttatgaaaatagaagtgcctggaaactgtaatctatacatgcttgttaccgtgataagaaaaatgatgtaatgggctgggcacagtgctcacacctataaccccagcactttgggagaccgaggcgggtgaatcacgaggtcaggagttcaagaccagcctggctaagatggtgaaaccctgtctctactaaaaatacaaaaattagccaggtgtggtggcacatgcctgtagtcccaacttcttgggaggctgaggcaggagaattgcttgaacctgggaggagattgcagtgagccagatcacgccactgcactccagcctggagacagagcgagactccatctcaaaaaaaaaaaaaaaaaaaaaagagaagcctgatgtaatgatgtaatgtatttgaggtgcatagcaataaccaattccatttctagtaataaatacaaataaaaatcacaacttgacattgaagcgattaaaagaaaagtgcatatccacaccagtttagagtttttctttaatatatgaggtctctcatataaagtaaaattccaagaggtaatagagaaatcaacgtggcttctcctgccagactgatcattccttcccagttttggttactgactatatcactgaaaagtcagttaagacactgctcttactagcggtgaaatttggatatggcttaaaaagctgcaattcaataaagcattaaattagattgctgatgaagtatattcaaggaaacaatttaccaatatttattaatcatatgtcaaattaaaaaatatgtttctaccaaaaaatttaaggacatctttcatctactaaagaaagagtgaagatatttttaaactaattttaatgcatagattatttttcaaaaaacataggtaaatactacagaatccattatcaaaactaaacttcatactttaaaaactaccatagaatttcagaattgaatttgaccttaaaggtcactttttagaaagcataatagaattgaatttagaaaagaaaaaaagaaagggaaataaaagaagaaaaaagtaaaatttttgcataaatactcctagctttttagctttctttctttttttttttttctttttgagacagggcctctttctgtcatccaggctagagtacagtggtatgatcatggctcactgcagcctcaacctcctgggctcaatagattctcccacctcagactcctgaaaagctgggactacaggtgcacaccactatgcctgaataattttaaaatattttgtagagacagggtcccactgtgctgtcaaggcagattttgaactcctggcctcaagtgatcctcctgcctcagcttcccaaagtgctgagattacaggcatgagccactgtgcctggccacacgtagctgtttaatggcaaactagggttctgaacatgatcacgttaatccaagtcatttcttctataaatggcttcttttggtttataaataaataacataaaaaagaatatgaaaaacatgactgcaatgaaataacctactgaaaagctttgaaattagtaaggaataccaataaaaatacttttttgtttccgttataacagaaacaaaacatttgttaacaacttcatttgttagttgattcaatacttttatttttaataactactagtattaatctctgtacataccaaaataaataaggcacatcactgatcttttaggatcacccaacgtggaaagagataagcacaaaatcagacagtataaaaaaggataataaggacttcattgcctttagaaaccattacgaagtcagaggaatagcaaaacccatgaatcatgctctgtatgctaccagtgtatactgtggagaaaggaagagctgggattagctgggcagcccctgcatagagctggtgaaactggattagtttagcatgggcagtaggtgaagaggaatggagtagattcaaggatgataatacgaatttccttgtcataacatggaaataatgcctatctcattagggggttataaagaataaaaaaggggccaggagcagtggctcacacctgtaatcccagcactttgggaagccaaggcaggcagctcacttgaggccaggagttcagaccagcctggatggcatggtaaaaccctgtctctactaaaaatacaaaaattagcagttgtggtggcacaggcctgtagtcctagctactcaggaggctgaggcacaaaaatcgcttgaacccgggaggtggaggtttcagtgagctgaggtcacaccactgcattccaacctaggcaacagagtgaggctctgtctcaaaataaataaataaataaataaaaattgaaaaggaagtgatacagacaggagtcagggaaatactaggtagaaaaggtccactctcaaacctggacctatggccctaaatgagaacatgcattcctattttcccacccaaatattgccttttccaaaaccaccctggcccatcatgatccccatcctgtaccataaaaaccccaagctccactggcagaggagcagagcaaagtggcaacgaaggagagaagagaagaagcaactggatgttggagaaaagcagctttacttcagaggaatagcttgatggaaggactttggagaagagttcaactggggactgccaaactccaggggaagactatcttcccaatccatcccccttccagctccccttcccactgagagccacttccactgctcaattaaaatcctccgtatacaccacccttcaatttgttcgcgtgacctgattcttccttgacacgcaacaagaaattgggtactaagagggcaaggtataaaaggatgtcactccgacccttcgctgagctgcttaacacttagctgtctgtggttggcaaatgctaaaacagcactgattgtaacacatgccctctggggttccaggagtcacagacaccccctctcagacagcagagctaaaagaccattgtaacacacatggacgctgccacagggcccgcagagagcctgctaatgccagacaggagtgaccagtcagttccagcgttcatttgccctggttcccgcacctgctcacctccatgctccccctcctataaggggttcagagctgcgggctgagtagatgagccaccccttcatgagtcctgtgaaggggtcaaaggaactatcccatctcagaagcataacaatggcagcattcataaaatacttacagtaattctaatacatggagaactcccaaaaacaagaattcagatagatggcatcaatggctggcacacatcctccacagcaggcttacccaagctcaactcatcagttttacaataaaaacaccaacccctttttacatggctaaattgttggatccatttagagcattatagtagaattttaaaatactatttactaatcgtttgtattatttcatgcatactccttatttaatctttattctataaggggagaactcttgtcctgtcttagagggtttagagaggttgagtaatccgccccaaattacacaattcaagagtgagtgtggccagaattcaaactaaggagtctgactccaaaggccatatcagtctaattcagtgattgacaaacaaaagcccacagtcaaatcttgcccactacttatttccatgccactaattttctaatttttttttttagatgaagttttgctcttgttgcccatgctaaagtgcaatggcgcgatcttggctcaccacaacctctgcctcccaggttcaagcgattctcctgcctcagcctcctgagtagctggggattacaggcatgcaccaccacacccagctaattttgtatttttagtaggacggggtttctccacgttggtcaggctggtctcaaattcctgacctcaggtgatccgcccgccttggcctcccaaactgctgagattacaggcgtgaaccacggcccccagcctcagccactcttattaagcactgaataactaaaattagtgttttttaataaaacaaaagactgcatctatgcaaaacttacattgcaacaaaatcatttctatgacaactaacactgtttcaaacccagtaaagtaaagctcctttatacacgttacatactgttgttttttgttttctggtttttgtttttgttttttgataccaagtcttgctctgttgcccaggctggagtgcagtggtacgatcttggctcactgcaatctccatctcccaggttcaagcaattctcatgcctcagacccttgagtagctgggattacaggcacacgccgctgtgcccagctaatttttgtatttttagtaaagaaaaggtttcactctgctgaccaggctggtcttgaactcctgacctcaagtgatctgcacacttcagcttcccaaagtcctggaattacaggtgtgagccactgtgcccaagctgtacacgtcacatactgttaaagacaaaacaaaacacaagatctccattcccacaaaaaatttgcaatgaatatgtttttcaagttcaaactatagttccagctgcatttttcagatcttaattaaaggaaaaacaagacaaaacaaaaatcctccatatttcagaattcacttaactgtgcaattgaggagctttcacttagctttcctgcgggagttgctggtatgcaatagaatggtacaccaaaatcaaatatcaagaggaaaatctaatagaattctgtttgcctttgagctagtgaatgtgctcagttaaaatcatatgctcacatattgatatcagtatttggcaaaacctatctgtgtgagaagatattttcacagataaaatacatgaaatttcattatggatcaacattaacagatgagtttacaattgattttgatgatagcaagaactaattttgaacgccagttaagcaaaatattatccccccattcttatcattcatagacttgtatgtttaaattttttaagcatttgtttgtttgtttgtttacttatttctttactgacacagggtctcaccctgtcactcaggctggagtgcagttgcacaatcatagctaattgcagcctggatctcccaggcttaagcagtcctcctgcctcagcctccaaatagctaggactacaggcatgcaccaccatgctgggctaattttttttttattttttactttttgtaaagtcagggtcttgctattttgtccagccgaccttaaactcctggccttaagtgatacttctgccttggcctcccaaagtgctgggattacaggtgtgagccgctgtaccagcctgtattttcttttaatgaacttgtcattattatattttgaatttcaacaataaaaaatttgtagacatttgttttctctcttcttatataaatagctacataatatcctcaattttgcctcatggcctacaaaactttaaatgtttactgtctgaccctttataataaaatggttgctaacctctattttaattccaacaaatgttcatttaatgtcatttgtcttccaaagttatctgctaaatatttgtaccttcacagtaatttccaatgtcactccacttgtctccaaaatattttggtaaaaattgaagagtatgaaaaaattgtttttctgaacttcctattattctctaaaactctaatatggtctggctttgtgtttcccccaaatgtcatcttgacttgtaatctgaattgtaatccccacatgttggggaagggaccttgtgggaggtgattagattatggggacgtctcccccgtgctgttcttgtgatagtgtgtgagttctcacaagatcagacagttttctaaggggcttttccccacttcactcctcatttctctcacttgccaccatgtaagatgtgcctatgtcaccttccactgtgattattagtttcctgaggcctccatagccatgtggaaatgactcagttaaacctcttttctttataaattacccagtcttgggtatgccttcgtagcagcatgaaaacagactaatacgaaccccttcacctcttgctggctcatttccttccatcctgtgccccacgccccctttacagatccccagtgttttcatgatacctactcattgtgaattgtcctctctccctaagcctttcattggaatcaaaattttccctcctcttcctgactctatcacaaatatcatttcagtacttacctgtcctcaagttaacaccattcagtgtaggcaggggtttggatccccaaaagtgagagtcctggctgatcctgacagatctattaattgaaagaagtttccagatggcagagtgaacccatggatgttgaccatattcttttcaacttaagaaacaactattggtgagcaagtggaccatgggctgctggctcctgaggtttgaggaggggagtccttgaatggaggcaacgtgtaaggcaaagattatgaaaaggatcaacaacacacattccaacatctattgccaaggcaagccattcaaaggcagtaatggcgtccctaggagcacgcagggtacggaggtgacttctctcagaatgacttctgaagtggtcccactcaggctagcttctgagcatctttctcccttccagtcacttcctaacatgagggcaaggatttccaaagttttggccaaatagatcaattgtgtttgtttacttatttctatgtataaactatcttctcagcaagccccccattatgtatgagctacatacatgttgactaataaaaagagctggtgatataatgtagttttcaactatatgctttattaattacagtctcatgaccagaatcagtggcaaaaaggatgagattgctttaccccagaatactttaaacacacatgctcatattcttttcttttctttttttttttgagatggagtctcgctctgtcgccaggctggagtgcaatggccaatatgggctcactgcaacctccgcctctcgggttcaaacgattctcctgcctcagcctcctgagcagctgggactacaggcacacaccaccatgcccagctaattattgtatttttagtagaggtgggatttcactatgttggccaggatggtcttgatctcttgacttcgtgatccacctgcctcagcctcccaaagtgctgggattacaggcatgagccaccatgcccagtacatgctcatatttatataattatattcaacctaagcccctcgtttttctttgtccttttttgactccacggatttcctcacccaggccggcccacagtactgcctttttctgtgcccaaactaggcttgtatgtctgactccttgtcctacctattattctgatataggtaggctgaatgagtgaggctaccttcttcagtatctactcaactctttattgatgataattccaatgcttgatggttttctttcagatgggtaaaaaccatatcacgattctgtgatttaaaaatatacaaagaacttgatgttcactgtccatgtattttatagacagttattgctgttttactatttctttacatatttcattctgtgttttctttccttgtcttttaaagtgagtctgctttccttcacttgatctatttatttcaaaagcacttttagatgtttttctacttaattttagtctccatcagattaaattacacagccgaccattttttttctactagccatataattgtagggaagtacatgtgccaaaatattacattactaaatatttgttattacctaagtcaatgcccgaatgtcaagatggtatgaggccaatgagaaaagcttagaaaacctacaaatgtgaggtggatttcatgttacccagaaggaaatgtgtattaaaggccagagagtatgggataagaaggagaatagattaatgcaatgtatttgggctttagttgttaacataaaacataaatacttccaatgactgagactagttaaaagaaagatcagcttctgtacaatagattctataaagaaaaagaacatacacaaatgatattctagattcccttgtaaaattctaataaagttgaaaatgattttggatgtaattgttagaaataaggaaaactgtggcacctatgaaatagaagtcacaattatattcaacagcaatcacaatttgaaaattttcaggttcttagtgaattgttatttaagtgagtgggaacatcaagctttaagaagtagagactgagaaaataagcatgttaccaaaaaaaaaagccatctgcaattgtgaaatacagaaggaagattgaagattctaaaacaaactcaggaaatgtgcagttagtagcactcagaaataatgcaagaggagaataaggctgatgtgaatgagtatgaaaattatgaaagcgcttgaacaaaagtaagaaagcatgtatcaaataaagcaccacaccagaaattgctactaaaacaaagagctaagagcaagaataaactattagaaaaactatcattatgatggagaactaacttataaagtgagtaagcacaacaaagttgtaaacatgttcagggcaaataaaccatgttgaacaagaatatagcgtaattttagttctgctgtattaaaagaactaaagtacataatatacttcaaaagtacataatatactttgaagaaaataaaataccttcttcgtgaattctgctaggctttttaagtcccttcatttaccttgtgaaaggacctattcttgttcatgcacagtaacagctgatggcaataaaaggtatgagttctttagaatactttacgtttagccaggttcacacatgagggttgggctttatgatcttttggtgaaataccagaacatttattaaaggatagtatactgtagttgaaagataattagattaggacccaggctcaagttcagttttaatgttttatcagctgtgtggctttggacaactcacttttttttttctttttctttttttgagagtggcctcatgctgtcacccaggctggagtgcagtgttgcaatcatagcttactgtaatgtcaaactcccgggctcaagctattctcccacctcagcctgctgagtagctagaactacagagcgcatgggactgtgcccagcttctttccttttccttttttttttttttttttgtagagacagggtctggctatgttgcccagcaattctcccacctagggcctcccaaagtgctggaattataagcataaaccaccatgcccagcctgggcaaataatctaatctcttttagcatcagctgcttcatctacaaagtgtttgtactaattattcctccagacagataccttaagctttaaatataaagcaattttgtactattcccaggactgatgcatagtgactctctctttttccttcaaatcttgatggttctggcaaagcttgaactcagcaacgtcatcgctgagctatataataaagaaaagaatacctacaaataggcgtgttgagtaaatccattaacgatgaaaacacatagccaaaaagtggtataccactttttcatcagattccttaaggagatgttcacagtgtaaaaggctttaactttaggtagctgacagcagtggacagtattgcttgcaatcagagataagctcagtgtgaacaaaacatctaatgattcggaagcagaaatagagcagtaaacattatgcagagtatagtgccatgccccctgtgagcactcaaaaaaaataatccatggtgattatgacaatgatgaacagaaccaggtcccgcaatcagtgtctagggccattaacaaaaagtcatgcacttaggagggggaggctgctgcctttgcggcatttactgagtatatttccactcactgggttacagggcagtgatgagagaaatgtagggctttgagaagacaggaaatggcctgttttgcgacccaagtaaaatgtcaacagcctgtcataaaacgattttcaatttctggcctgcaaccttatttacattttttttcttaaagataatttttttttcttagagatactaaataattttaggaaaaaatgtcttctgcaagttacttttatcagaaagccagagcatagtttatttaaggacatagtttgaaagttgctttaactatctgagggaaggccaggaaaggctctattttcaaataaggacctgaccagaagaaagtgggaaaaaggctgaataaagaaatcaatggaactaaaagaatcaagaggtgcttctttgcattttgtaatttttctacagtgagcatatggcagaaacttgtcacttgtcactatctcttctccccttcttcctggataatagaactccaattttgttggaggttattatcaacgttccaagcttaatgtgtaatatgtaaatatattcactttcacaaatccctttgcagctaagggaagctatgttgccagttttggctaataagatacagacagacatgcctagcgccagcatccttctcaagataagacagagtcttgtgggaaagggttacatacctatccctttctttctgcctggaatgggaatagaaggcctggagaggtggcagccatcttgcaaacatgagcactgtcttaatccattaggactgctataacaaaatatgccagactgagcaatttataaaccacagaaatgtattgctcacaattctggaggctgggaactctgagatcaaccaccagcagactccatgtgtggtgaggacccattcctcatcaatggcaccttctacgagttctcacatggcagaagggcaaacagcctccctcagacctcttttataatggcagcaagcccatttataagggcagagccctcatgagctaatcatctcccaaaggcctcacctgttaatgctatcacattggagattaaattcaaacataaaaatgttggggggtacacaaacattcaaaccataacaagcacaaaggcagcaacaccctgaggagggcagagtagagaaataaaaggagttcgaatccttgataattttgcagaacttcagtgataacagccctggactacctatctctaccccaaagtgctcatgagaaaaattaacactttctgtgtttaagctactattcatcaggatttttatagctcaaagccaaacataatattatgtccagtaaaggcctatttcatttttgtgctttgctttattgtgcttcaaagataatgcattattcttctttttcttctttttttggagaccaggtctgactctgtcactcaggctggattgcagtggtacaatcatagtttactgaagcctcaaactcctgggctaaggtgatcctcctgactcagcctctggactagctgaaactacagacatgcaccaccatgcctggataaatattgcattattttacaaattgaaggttggtagcaaccctgcgttaaagcaaatctataaatgccatttttccaacagcatgtgctcaatttatgtcacattttggtacttctaacaatatttcaaactttcttgtgattattatatctgttatggtgatcggtgaccagtgatcttcgaagtcactattgtaattgtttcagggctccacaaattgtgcacatataagacaataaacttaataaatgttgtgtgtgttctgactgctccacccactggccattccaccgtctctctccctctccttgggctttccaattccttaagaaaaaacaatatcgaaattaggcaaataaataaccctgcaacggcctctaagtgttcaagtgaaagagtcacatgcctctcatcttaaatcaaaagctagaaatgattaagcttagtgagaaaggcatgttgaaaacagcaataggccaaaagctaggcctcttgcaccaaatagttagatatgtgaatgcaaatgaaaagttcttgaaggaaattaaaaatactactctagtgaacacacaaatgataagaaagcaaaacagctttattgctgattcggagaaagttttgagtggtctgaatagatcaaaccagccgcaatattcccttaaatcaaagtctaaacctgagcaagaccctaagtcaactttgtgaaggctgagaaaggtaaagaaactgcagaagaaaagttggaagctagtggaggttgttggttcatgagagctgagaaaagaggtcacctccataacataacagtgcaaggtgaagcagcaagtgctgatggagaagctactgcaggttatccagaagatctagctaaaataatcggtgaaagtgactacactaaacaacctattttcaatgtaaatgaaacagccttctattagaaaaagatgctatctaggactttcatagctagagagaagttaaggcctggcttcaaagtttcaagtgtcaggctgtctgtcttggaaaaagaaaatgtagatgacagcacatctgtttacagcatgatttactcagtattttcagccaactgttttttttgttttgttttgttttcgagatggaatctcactctgttgtccaggctggagtgcagtggtgcaatctccgctcactgcaacctccacctcccgggtacaagtgatactcctgcctcagcctcccgagtagctgggactacaggcatgtgccactacgcctggctaactttttgtatttttagtagagagaggttttcaccgtgttgaccaggctggtcttgaactcctgacctcaggtgatccaccctcctcagcctcccaaagtgctgggatgacaggcatgagccaccgcacctggcctcagcccacttttgagacccactgttgagaaaaaagaaaaagattcctactgcttttgaacgatatacctggtcacctaagagctctgatggagatgtactaggaagtgaatgttgttttcatgcctgctaatgcagcattcattctgtagcccacggatcaggaaataaatttaactttgaagtcctactatttaagaaaaatattttataaggctacagctgcaatagacagtaattcctctgatggatctgagaggagacaattgaaaaccttctagaaaggattcaccattttagatacattaagaatttgcatgtttcatgggagttggtcaaaatatcagcataacagcagtttggaagaagttgactccaaccctcatggatgactttgaggagttccagacttcaatgtagaaattaactgcagatatggtggaaatagcaagagagaactagaattagaaatggagcttgaaggtgtgactgaattgatgcaatctcataataaaacttgaatagatgagaagttactttttatgaatcagcaaagaaagtttttgctttgtggtttttggggtttttttagacagattctctctgccacccaggctggagcgcagcggcgggatcttggcttactgcagcctccacctcctgggttcaagtaattgattctcctatctcagtttcctgggtagctgggactacaggcgtctgccaccacacctgtctaatttagtatttttagtagagatgggtcttcagcatgttggcctggctggtctcgaactcctgacctcaagtgatccacccgcctcagcctcccaaagtgctgggattataggcataagcgactgtgccaggccagaaagtggtttcttgagataaaaataacacctggtgaagatgctgtacacactgttcaaataacaggatttagaatattagcataactttattctaagttatttagaataacttagttggtaaagcggcagtggggtttgaaaggatggcctccagtttttaaagaaattctgctgtaggtgaaatgctgtcagctttgcatgctacacagaaatcttttgtgagagtccactgatgtgacaaagtttatttttgtcctattttaagaaattgccacaaccaccccaactttcagcaactccaccctgatcaatcagtggctatcaatactggggcgagatcctccaagagcaacaaacagattacaacttgttgaagggtcagatgattgttagagttctttagcaataaagtatttgaaaattaaggtatgtacattttttaaaaaacaggatgtgattacacatttaatagacgacagtatagtgtaaacataacatttatatgccctggaaaaccaaaaaattcttgtgccttgcttcattactatattggcttatttcagtggtccagaaacgatcctgcaatatctctgaggtatgcctgtataaatacaagaggcttggacctaatttaggataagccctaacgggagcttttactttgtcaaaattatggtaaaaagagtctgcctaggaggaaaacaacaaagtaaagttcaaggaccccaagaatccacccttcctcattctacaggtgactcaatctgaggccaaaatctactcacaacatatagtgttgcccactcaggcagattgccttcaagacccttggtcttttagagtcaaaataattctacctgaacctaacaggtgaaagacaatctgagacaccagagttagaaaataaagaggcatctgtatcaagtgtccagtggaattaagactcagttcctccctgtggtggagtgctgagactcaagttctgcaattccagtcctaacttgattaagcctcaaccctgccttatctgctcatcttgccttgaatctcttcctggaaaagtctgcattgacagctggcaatcaccactagcctcgattctgccagtttcttggcctgtctaactatctgcctgctcaaccacttaaccacttaaacctggctgtccctgtgtggcttcaagctcctgttaagtaggcccagtgttctcctatccacagccttaatgtctctctatcttatccagctgaatgagaagaaattacaggggggtcaaggcaacacaatgccttcgctgatcaatatggaaaaggacaaattaagagccttttaaaatttaggcagactttctgtaaactgtgtaaaattatcacaaggcttaatgctgaagagcctcaagtagcatttgcagagtgtgtttcttgaaataaatttcagtgatggaatagatttgggaagcaatgttccatactttcccccttggaagtccacaatgagcactagtggatgaaggtccttagaagtccacatagaggaaactactttattttttaaaactttaacccaatgcttcataaaaatactttttttgtattattttcaaatattccgtggaacacaatttgaaaagtgcatgaggacaaaattttaaaataatcgatgggaagatatcttttggtttcaagctggagtccagtagacttaactctacagtatattcaataaataatgtctgaactggattaaagtaactagtaataaaaatcctgaatttgacaagagacatttgtttccctaaactttagacattaaggtttaagtaaaaaatatgtatttgattctagttagctaaatatcactttttattgtcaatattcagaagaattcatggttagaaaatctgaattttagaagaaaaaaacacagattgttagtttgatgtctatgaccaatgttcctctgtaacctggtgacactgttctaatagtagcaaaagtagctaggaagaaaatgtcagctttttaaagaccaaagctacacattaaattgaaaaaaaaaaggaatgttattgtactagtattatttatcagcatatacacatgcacataaacacatatatatgcacatacatatacatattcatgtatacacatatctcgatatttgctagacatttgcatacacatataaacacttgggattatttatttgatttattctcatcatcaggagagtttttaaatggatgtgaaaagaaagctatagaatgagaagtacaaatctgaaatactaaataaaactgtcaggaagtttaagattcatggattatgtatgaatcatagggtggggaagaattgatattttcaggccaaatgctaatgaaaggtgttctagtacataaaacaatttaaagctatatttatcaaacctctttaattcatgtttatagacatgaattaaactcttcttagagttggagatgagaggacctgaaaaatcctttgtccaaaccttctgatttcatgaatgatgaacctgagaccacaaaacacagatggcttgtccttaggtgagaatgcatcgatagctaagctaaaaccaaaaccatgtttcctaattgtcagtcaggtttctttatcaccagatagatacaagttggtggatttttcaagctcagaaccgctctcctgtcatgcaatacatctcatgtattggcatccatccgggccttttgtgtcacccctgtgggactggagaacaaggtgaatagacacaaatatgttgataaggttgagtctcattgtcttctgccagactgtatgaaacagtaacatgctagataacagtttataactagggtaaaatcaaatcctaagcctgacacagacctcatagaaaaacattggaaattattacctccttttttattttacgtgaaactatatgtaagatttgcattctttcttacttttttttttttttgaagttgcaagatttaatagagtgaaaccagagctccaatacaaagagaggggacccaaagagggtggccgttgccagctcgaatgcttggttttatatcccgatcattgtccctcccgctgtgctctcaggcaatagatgtttggctatttctttacctcctgtttttgcctaattagcattttagtgagctctctttactacctgactggtcgggtgtgagctaagttgcaagccccatgtttaaaggtggatgtggtcaccttcccagctaggcttagggattcttagttggcctaggaaatccagctttctttcttaaatgtttgacagaattagctttctttcttaaatgtttgatagaattcataaagccatttaagactcaagctttggccagttgtggtggctgacacctgtaatctcagccctttgggaggctgaggcaggaggattgcttgagccccagagttcaagaccagcctggcaacagagtgagatttcatctcttaaaaaaattagccagatgcggtggcatactcctgtagtcccaactacttgggaggttggggtgggaggatgacttcactttggcccaggaggttgaagctgcaatgagctgagatcatgctattgcagttcagcacaagcaacagagcaagaccctatctcaaaaaaaaaaagactcaggttttatttgtggaaagactgtaaggataaattcaactcagttattatggggctatttagattttctattgcatcagttttgataactggtgtttttcaaggagtttgtctattttatcttaaattgtcatacatattggcaaaaagttcataatattccactattatccttttaatatacatattatttgaacaaaaattcctattttttcagaaagttgtagtttttattttctttttgacttttttgaacttaccaatctagctgtagttttatcagttttattcatcttttcagagaaccagcttttggctttgtcaattttctcccttgcttgttttatatttcttatttccacccttatctttattgtttttgtgtctttttatatatttgggtttaaatgcttgcctttttctaccttcttaagaaagtagaaatttagagtgatcttaaatcattttgcttattcaattttagaatttttcttttaagtcctgctttagcaatatccctcaaattttcataggctgtatttttgttataattacacacaaattaagtttttatttaattgtaattgttttctttgacccatctgatatttaaaaggcagttctttacttttcaaatgtcttggcttttctaaatagcttgtgttattaatttctaatttaagtctgttatcagttaacatagtttataatatcaagacgtttgtatgttttattttccaacatatggtttatcctggaggttgtacgatatgccttgataaaaggtgttcatatttccattggactggtctgtatctgtcattagttccaccagcttttactttaggtatttttgtattaacgtagtacgtctttaggtttaactttcagggcagccgtatgaagaatgatgtcatacttacttttgatttcttacccagtgttgccagtctaacacaccttcttagcctttctgcatacataaataattaaggttttgttctggttctgaagcactgtgaaagaataaactcttcatcaacaagctctcaggatgtcattatttcctgagaacgtaaactctgtgcactaaagctattttgcacaaaatctacttctaattaagcaagataaggagagaaggtattgtgtaaaaaataactaacaatcaggatgtcacaggcgtctgccaaaaatcagaatggatgctgttaaatatcttgaagtaatatgtggtggaacatgttgattggccactcaataaccattccctcttttgtgtttactaaaagaatcctatttctgttttttttaaaaggaccctcattttatttttattagcgatgcaacaaaaaccaaaacaaaaacccacacctatttctccggctctgtttcagcaaaggctacccatatatggtttggtcaatgaaattagctgaactctgccaggaattcctgtgctgatttgtctccctgacatgggcacctgccctcccacctcataactttcttattcttcctgactggaatagagaaaggagattagtgatgaagaataacacctggcaaccaggaagtcatcatgaggaggacggagcaaaagatgaattacgtctaggatgttgacgacctcatgaagccactataccaatctcactgacctatatccagactttgtatgtgagaaaaagaaacccctacatggttaagccaacaaagttatgtctctgttatagtcagcagaacataatctctaactaataccaaaaaagaaaggaaattcatgactctatcagaagccaaattcaaacttctgcgtgagttacatttgtccgttttcccctcttctagaatagcttctctgaagaatactttttaaaggttactatgttatcatgcaaagaattcagtgcggactctcccccattatgcagcattttggtaatcagaaatcatctgagtagtgtttccctttctttgaaatagcactactttttctaaaatgagacattaagtccaggctatcctgaagaacattgttgactgcccttttgtaaaacaattcaacttcttacatagtttgaaagacattcccaaggcgaaatttctacaaaattattttcatatctggaatctctgcaaatatgttttctgtaactgccttggccttttctgtctgagctaaagttatgcttaacacttttcttaaggagagttttaaatttgcagcgctaatccctttcacattagcacgcaacctcagcatcaagttctaacatgcatgtgctgaggaattaatcaaaaccttttataatcaagctgtcacataaatgtctactgatgcaaacttccacatgtaagatagacagtaattccagcatttaggatatggctctggatgccctagtgcagcattaataaataaaagaatgggctatttttcagctttgctaatctaaattagaatattttgcaaaggtgagtgattatccctgaaggactataaaacgtgtctgtgtacgtgcacacacacacacacacacacacacacacacacacccctcccttagcattttccaattgcttcatgaatgaaaccagtggaacagaaaaaaaactaagtgtcagtatttagcaagtaagcaaaaagtcttgaattttaaacgctgcataggtttagaacagataaaccgttcaagtctaatagataaaaaattcaaaatagaacctattgtggcttaatcagtagttcaaagtcgttacaggccaataataattagatcaaaaatgccaaggaatcgttgttgaggcttaatggttaaactatgaaccccatctgcataagatgaacaatttctaaatatcgttcttaccttttttaaaaaatggattccaagacatctacacattttatacatctgagtttttctgctgattttggtggttgactaaaactttgggccagaagtgagtgatcttttatttggctgctgaaactgactttctgttccataggaatataaatccattttagtgcattataactactgtgttctcattaagacattatacaatagactggattcagtcaccccctgaaagttgtacttgtgctgttacataggtagggacaaatatacatatagctgacaagttatctcccaagtgtgtaaatatgattgagaaggctagagtgtgcccaactgtcttaaacaagctcacgatatttatatctgacctttagttaatgatataacctgcttctatatggtctgtcaagctcaggattgagtattttgcttaaactttgcacacctttgattacttcatgctagcaaagtccatctgttgctgtcattgcacagctatcaatttcagtgttaccttgcttcaactcatgccttaaaacaatcaagctgacttggaacgtccacagagtagataatgtggcataaagacatcattcaagcatttctgttttttaaaactccaggtccattcttaggcacaagactttttctgttcccgcttctgctttgtggcagccaggacttaacttagtgtctgttctacctctcagctgccacctcctgctctgtcccttgcttccatttctccaaatggcttgctgtccctaaaaacaggcacgcaggttgtttattcttaagagttttccagctattcatgatgtgaactggcgatcactaaaaatagcaacaatgaatctgcatgcaaaatgatttcaaaactcttggtccttggtctaaaataatagtctctgcctgtgatgaaatctagtaatatttctgttctcagtttttgtttcttgagaggaattccttactaaacacttcctccacattcagactctatcaatgcagataatagtggcccctttgcctcaagtagaaattctgattattaaagaataattaggccaggcacagtggctcataatcccagcactttgagaggctgagagaggattgcctgagcccagaagtttgagatcagcctcaaaaacacagtgagaccccatccacagttttttttcaattagccaggcattgtggcatgtagcatcagctactcaggaggctgatcatagttcaatgcagcttcaaactctctggctcaagcaatcctcccacctcaggactgaggtgaggtgagcctgagagtttgagactgtattgaactacaattgtgtcgctgcactccagcctgggtgacagagcaaggccctgtctcaaaataaaaataaaaacaattttttaatttcttaaaatttttttgaaaagaatgattagcttgatatttcttctccctggaacaaatgcagtcctcattagcaatctaatttttacagtaatcgccttctggaatctcatccttgtttgtctttcaatttgcccatcaaaacatagcttatgttgacatagttattttgattttttgcattaataatctgacaggaatttggggggaaactgtcttccaaaatggttggcaatcaaaacaacatcaaatgaggccaatatacaaaagtgctaatgttcttaatcccttccaaaacacccaaatactatgaatttaaaaattctgctgtgaagctttaaagttcactatcttatgatgaattacagaaaatatttaactgactaaaccagcttcctctggagaataccataacacaggcttggcatccctccttttcacccttgctaattgaatacctgataattagttgaagtggggcctttttaagtttgataaatgaaactttaaaaagcagataatctacatcttaaaaaagctcttccagaaaaagaaaagaggcctgcaatgctggctcacgcctgtaatcccagcaccctgggaggccaaggcaggcggatcacctgaggtcaggagtttgagaccagcctggccaacatggtgaaacctcgtctctattaaaaatacaaaaaattagccgggcatggtggcaggtgcctgtaatcccagctactcaggaggctgaggcaggagaatcacttgaatccaggaggtggaggttgcagtgaactgagattgcgccattgcactccggcctgggcaacaagagtgaaacttcatctcaaaaaaaaaaaaaaaaaccagaaaaaaaaaaagagattgtacctgtcactttatataactagtaccctgatattaaaattggataaggacgatataaaagaaaaagaaaaatagttcacttctaaacagatgggaaaatactaaataaaatattagccaaataaattcaaaatgtattaagaataatacagtgtgaatagatagggtttattctaggaatgctagaaacatttcctgatcaaagctctatcatgtaattcattatagtagtaggctaaaggagaacaattaattatctcagtagacgtagataaagcatttaatacaattttactcttatttaatacaaaacaaaagaaaaactaggaaaactgggagcaaatgagacgtcctttacttggcttatgatctgtttctatccacagaatacttttggcaccaaatgtgtggggtttgttcccacacattgtgtgattctccagacaccaactgggagttcaacaattcaattccattttgacactaactacctagagttagagcagatcccacagtttaagggctcagtccctcaagactgcccccaactccagaagccagttgcaagtcccaggcctcctgtactttctgatggctatacgttaagcattcccatgacctcctcctaacgtttgatagctttctagaagggctcacagaactcaggaaggcaggtaactcacatttactggtttattataaagggcacagctcagagtaaggtacttggggaggggtgcagagaggcttcacacactctcctgacaccactccctcagggcctggatgtgttcaccagtccagaagctcatcaaatctctgttgttcaagagttttcatggagcctaatctcatttccatgaccctttccaaaggtcagtgggtgaggccaaaggttctagccctctaaccctcaccttagtctttctggtgaccagccccaacccgaggctacttggggactcatcctaagtcacttagaacaatttatagtaaacaaaaagtatttgattttttaagaaaaagaaaaaaaagtttgtgcttaccgaagaaattttgaactcaacaagacaaagataccgtatatctcaactacagttcaacatactactgaaggccctggccaacaaagcaagacaaagaaaataattactgaccttaagaattggacggctgggcactgtggcttatgcctataattccagcactctggaggccaaagcgggtggaacacctgaggtcaggcgttcaagaccagcctggccaacatggtgaaatgctgtctttactaaaaatacaaaaattagcccactgtggtggtgcgcgcctgtaattccagctactagggaggctgaggcaggagaatcacttgaacctgggaggaggaggttgcagtgagccgagatggcgccattgcactccagcctgggtgacagagtgagaccctgcttcaaaaaaaaaggaattggaaaggaaaagatgagactgccattgtttgtagacgctaagatgatctctacatagaaaatccaaaagaaagaccaaattagtgtatctaataaaagagttaagtaaaatttctagatacaagataaactttaaaaattaatagtatttttccacaccactagtctcaaaatattagttcctctaaaaattaatacataaaacttttaggcttggcatggtggctcatacctataattctagtgctttgtgagactgaggcaggaagatcatgtgaagccaggagtttgagaccagcctgggcaacatctcaagatcctgtctctacaaaaataataataataataaataaaataaaataaaaataaaactttgaaaaatatataatccttatttttaaaaagcaagccagcctgggcatggtagctcatgcttgtaatcccagcactttgggaagccaagttgagtggatcacttgaggtcaggagttcaagaccagcctggccaacatggtaaaactctgtctctataaaaatacaaaaattagctggatgtggtggcgagtgcctgtaatcccagctattccaaggctaaggaaggagaatcacttgaatctgggaggcagaggttgcagtgagctgagattgcaccactgcactccagcctgggtgacagagtaagactctgtctcaaaaagaaaaaaaaattaaaaagcaagccaactcattttatgagcctattatgaccctgatatttatttatttatttattagctacaattatctacttcacatgcaatataatgcagaggctaagagtaaaactacctttgcaaaaattataacagtgagaaaaatctaatctaactgactccatcttgcttctaacctcagaagctaattgctctcactcatttctgggtgtaggccaaggtaactatggaagaaatgtagtttacagtttaactttgaagcaaggatgataatagtccctcccaaaactgaccccctctggggacagaaactgcctttggaagaacactgaaaggctacagggttagggttatgggagggacctgaattctgcaaagatgtgggcatatttaaataaaaagcagttattgctccctagcttgcttttctataattccttactgttcaggagtcatgtagctagatgtcactaggtttgtaacttctccaattgttcctatagataacattactatagattggtttttgagatatttttcagacttttacattcagtcagaccaagtgatgccacctggacccatgattcataccaagaaactgactcagcacaagaagacaatttggatgctctgatgatttcatccccaaccaatcagcagcacccattccctagccccttgcctaccaaattatccttaaaaaccctaggctccaagttgttggtgaggcaaatatgagaaacatctcccatccttctgctcaactgccttgcagtaattaaactctttctctgctgtaacactgctgtctcaatacattggctttatctgcacagcgggcaagaagaaaccattgggggtgtaacaaggacaagattgcctagactcaaatcttggttgtgtcattatctgtatgaatttaggcaagttacgtatcccttctcagcctcagctttctcatctgtaaaatgagaacaataataatacttatcactttgggatgctgcaaggattaagtgaatcatacttgaaaagcacttaaatattcatagtacaaagtcagtgcctcataaatattatatattattataagtatagagctaggttattaatccattaggaactacttgccttaaaattaaaatatttttaaaaataaaaaaaatttaaatatacagaaatgctaatatgtttttctcttccccaattgagtgttcacatttcacactgcaatcaagtgccttacacaataaaaaaaattaaaaatacaatagaaaataatatgccactgaatatatcaatctatgaaataactaggaattaagccaataaagaaagcaccaccttcacagagagacttataaaattaataaacttaatccaatgagaccttaataaaagaagacacattaacattgtaaagctattaattttttcttaaacttacctataaatttaatgtatttataattaaaatctcagatgaatttcaggaggaatatgaaactgattctaaatataacctggaagtttaaacactcatagaaagctaatataattttgaaaagaaagactaaaagtgggaactcactttccaagatatgaagacatattataataccaccgtaataaaaatagtattgacgtggggcaagaacagatagaccaacaaaactaaagaggaagaacagacatatataactgtgaattctgcatataacgatggcatcatagataaaagacctaaatgtaaacataaaagttttaatcaaagttttttaggtttcctgcataagaaaccattccaaagtctcagtggcttccaaaaataaactttttttttttttgagatggagtcttatttatttatttatttatttatttatttatttatttatttgagtcagagtctcaagtctcactctgttgcccagggtggagtgcagtggctcgatctcggctcactgcaacctctgcctcctgggttcaagtgattctcctgcctcaggctcctgagtagctggaattacaggtacccaccaccacgcccagctaatttttgtatttttagtagagacagtgtttcaccagattagccaggctggtctcgaattcctgacctcaagtgatccaccctcctgggcttcccaaagttctgggattacaggcatgagccaccatgcctggcctaaaaataaacattttatttctcactcacaaatttatgatcagataaaagaactcacattcaattgactaaggtagtcaaatggcctgacaacggtgtggtgaagtcttatcctctagagaaagacacatcaatgatagcattaataaaactgctgtgaggaagcaagtgaatactggaaacaatgatcaatttagcataataaaactataaagtttattaaaactgtgcatgaggacatttttatgacattggtataaccttggatttgggggaaagaacaaatcacggtataaaatgttgataaatctgaataaatcaaaagtaaaaatgtatgttcagatagaaaaaaatagctaatatatgatggaggaggaaaataaattagcattatacaagaggttattttctagagtacgacaaaaacccatatgattcagtagcttatatacttgaagagagcgggtattattattactattattttctgtattgatggctattttagctccagtgctacgataagtgcctggcaatattgttactcctcactgttaaacctccttactgtgtatcctgtttcaggatttgcttctgatctattcctctctaaaccagatatattagtttcctattgctgctgtaacaaattatcacaaattcagtgggttacaacacaacagattttttctcttactgtcctggaggtcaaaaactcaacatcagcctcactggcctggagtcaaagaatcagtagggctagttccctctggagtcaacggggggagaatcggtttccttgccctttctggcttgccgaggtcatcagtgttccctggacgatggcctcttcacccttcttcaaaggcatcagcatagcatcaccacccgccttcactaactctgcctctgtcttcggtcagcttttctgtctttgaccctcctgcctgccttttatgaggacgcttgtgattacgttgagcccaccaggacaatgcaggataatcccccacctcaaaatctgtaattgaatcacacatgcagagtccttgtgtcatgcgaggaaacatatttataggttccagaaattaggacttgaacactttttggaggcccctattctgtctaccaccccagggtttctcaaacttggcacaattgacgtgtttgcctggatcattccttgttacggtggcttgtcctctgcgttgtaagatatttagcagcgtcctgctgtgtgctccttagagcacatccccttcccctagttgtgaccaaatgtcacctgaggggcaatattgcctctggctgagacccattgctttatcctgttctagtgatctttttaaaaagcaaatccagtcatgtcactttcctgcatagaattgtgtgttgcctattattttcaaaacaatattcacatttcttaatatatcataatagattactcacagtcgggctttgctcatttctcttggttatttctctgtcttgctgatttttctgactgccctctctttccatcttcttgtcctccatatattcttgcatttcccctgaatgtgaggttccctcacacctcctggctttgtaaatatctcttcctccatccacctagaaaacaccttctattcttcatctgatgaacttttacttacttctctttaggagccagcttagatgtctgagaatctaggtcactttctcatgtacactctgagcacgttacctcaattagagagctagtgtttatttcctcttttccctgcactagtctgtgagttgtttagatctctgaccattatctgtcttgaagggtttaaccctcttcctggaacatattagttgtacaataatcgtttttggaatgatggagtaaatggtggatttcatgcctcaacttgaatacactctctggtggctgaaactgaggaagaatgttgctccaaaatattaacgggtgataacttgcttttctattttaaaatagaaaaattaattctcccattctcttgcatggaaagaaccactcaaacggaaattattttgtatttagtcactatttagttattattttttccaaaattaaggctcatgctcagaagctatttttcttaatatgtttgagtttttaaaaattggaaaaaatatctcttccaccaagaatttggcaaaagaaagctagaattaaacaccgcaataataaatttcacaacactatgaaaaggctaggtatgtcagagctctttcctgtatcaggaaggcatggttgattttgcaatttaggtttttactttgcaggcagaaaactgtcacctgggcacttccagccttcactatgtaacaaaaaaactgatttgcaaagtcccaacatttggcgtacgctccaaacaataaaagtgtcaaaatggtttctgttgctgtgcattttattattcttctgatagttgaatgttaaagtttctcttaatgtttagaaactggagactctttagtaaataccaccgaaaacacctgcatataatgcttgctaatgaggtttcctcacttcaaagctcaaattaagagggtgctgagagaggatggatgctctctctgtaccttttaaatatattcaggtaatttatgtaaagcaccaaaattaaagacatttcccccatgctatacttttatcactccagttaaaaatctgcccacagacactgtaagaatgatataaacaaagttttgctatctaaaatatgtcaaaacataatatgctaaaataagacttttggattgtggttagttcccatataaggctgactaaaatgttttcttttcctttaaaacacttttcttaaggttgttactaaacatatttggttgagtgccagtgtcacataattgatgctgctgaaaatatttggttaagactacagcttgcctggttgaatcctaactctgcaaccttgagaaagtggcttcaccgctctatgcctcagagctttgatttgtaaaatgagggtaacaataatagttccaacctcagaaggctactgtgaggactaagagccaatatttgggccatgtggcatgactcatgcctataatcccaggactttggcaggccaaggcgggaggatcacttgaggccaggagttcaagaccagcctgggcaatatagcaagaccctatctctaaaatatatatatattttaaattagcaaggcatggtggcgagtgcctttagtcccagcagttcaggaagctgaggcaggaggatcacttgagcccaggagttcaaggctgcagtgaaatatgattgcgtcactgcacttcagcctaggtggcaaagtgagaccctgtctctaaaagaataaaaataaattaaaaagagtcaatatttgcaaaacactccaaacctttcctggtacatgaaagcacaaagtaagcatctgggattattattagagaaaatagaggaattttgtactaaggactcttcaaagtgttaagaactcagcattgtgcagggaactctacccacctactatcagcaactgtgagttccatctattccttaataacagtaagcaaataagggacccaaaccacagctcttcatagcctaaaatgcagccctggattttggttagtaaatgtattaaatacttctgtactaaatctgggtttcaaattcagtaagaagttttgtgaatttgtgggtttgggatccctacacttgctgaaaaatttcattggctgcatattatcccaggaaaatgagttctattttccttgatttgtgttcttgacaacatagtacctaggaatttttgcagtgtcatctaccattacttacctacctgacacttctgctttaatcactgtgcccaaagtacatcacgtatttttccatattccccttgcttagaattcccttaattgacttttctacttccctagggcccccacttctgatgggaaccctcttagcttccatctcttctctgatcatatttgttagattacattgcttctgagtgatcggttccttcaatgaattctcctagtatctgtatcattttttgtacatagcatgagatctcttttccttttattacatttttttaatgcctgtatctctaaccatattgtaatgtctttgtgtacaaagactcctctatgtcacgatgtacctcagggcctggctctgtgccctggacaaagcaagcatgaagtacatttttttattaataaaatcattggaagtaaaatttatattatttttagctcccatccatctccttttggcaaactgttacccctttcaatgctttttccactagtattatgtatttatgtgctgtatattgcctatttgaggtcttgaagaaagctatctttcccagtgttttggaaatttttatttcatcaacacttacctgtgttgttagtgaaaaagtactgatccaggagcaaaaaaatgtaggttatcttaataacgactaacccgaaatgaaactgcttcttcatctgtaaaatactaaagctaatatcctccctgactactatacaggttatcgtgaagacaaatacatacaaaatacagtcatgtgttgtgtgacaatagtttgataaacaatggaccgcatacactacggtggtcccataagattgtaatggagctattgcctagtgatgtcatcgtagctatcctaacatcatagtgtaatgcattactcatgtttgtggtgataaacaaacctactgcactgctgtcctataaataattatgtacagtacataatatttgataataattggctggtataaacaaacttactgcactgctgtcatataaacaattatgtacagtacataatattctataataattgactatgttcctgctttttatatacaatatactgtgcattttatgattattttagagtttaccccttgtccttattaaaaaaagaaaaaaaggttaaccatgaaacagtctcaggcaagcccttcaggaggtattccggaaggcattgctgtaagagatgacagctccatgcatgtcgttgcccctgaagaccttccaggggacaagatgtggaggtggaagacagtgatattgatgatcctgaccctgtgtaggcctaggctaatgtgtgtgtttgtgtcttcattttttcaaaaagtttaaaagtaaaaaaaaataaattttaaaatagaagttatagaataacgatataaagaaaatagttttgtacagctgtacaatgtggttatgttttaagctaagtgttattacaaaagagtcaaaaagtttaaaaagtttataaagtaaaaaagttacagtaagctaaggttaatttattactgaagaaagaaaaatactttttataaatgtagtgtagcctaagtgtactgtgtttataaagtctccagttgtgtatagcaatatcctaggccttcccactcacccaccactcactcactgactcacccagagcaacttccagtcctctaagctccattcataaaaagtgtcctatggaggtgtaccattttaaaatcttttatactgtatttttactgtaccttttctatgtttagatatgttaagaaacacaaatatggccgggcacggtggctcaagcctgtaatcccagcactttgagaggccgaggcgggtggatcatgaggtcagtagattgagaccatcctggctaacacggtgaaaacccatctctactaataatacaaaaaaattagccaggcgtggtggcgggcgcctgtagtcccagctacttgggtggctgaggcaggagaatggcgtgaacctgggaggtggaggttgcagtgagctgagatcacaccactgcactccagcctgggcaacagagcaagactccgtctcaaaaaaaaaaaaaaaaagaaacacaaatacttaccattgtgttataattgcttacagtattcaatacagtaacatgctgtacaggtttagtagcctaggagtaatagtctataccacatagcctagctgtgcagtaggctgtcccatctatgtttgtaaaagtgcactccatgatgttcacacaatgtcaaaactgcctaatgacaaatttctcagaatgcatcccatcactgagtgacgcatgactgtaatgtacacaaatgactgcacatacggttggtctaatgccctcgggaatacatcaagattactggcttgttgctctaattactgacatgtcacaggttaacgtaatgtattactaattttccataacatttattttagaagagacccttgaaaacatcaaatctcaattcaaaagaatgatattaaaggcccctgggaacagatagtccaatttttcaaccttaagttaataataataattcaattaaacaaatatttgttgaatatctattatatacaaaaaaagcatcctggctgctatggaaagtataaagatgagatctcttctgtctttaaggaatgagggtctagtctagaagaccaaaatgtacaaaatgtacacaaattactttaccacaaggtaagtttggtaagttctttggaagaactaacttcagaagatatgaggttaattctgactgtatcaataagggttttagaggatatccatacaactggggcttaaaagttgggagaacttggccaggcacggtggctcacacctgtaaccccagcactttgggcggctgaggtgggcggatcatgaggtcaagagatcgagatcatgaaggccaacatggtgaaaccgtctctactaaaaatacaaaaattagctgggcatggtggtgcgtgcctgtagtcccagctactcgggaggctgaggcaggagaattgcttgaacccgggaggcagaggttgcagtgcatgttggtgcatgcctgtagtcccagctactcgggaggctgaggcaggagaactgcctgaacctaggagatggaggttgcagtgagccgagattgcaccactgcactccagcctgggtgacagagtgagactccatgtcaaaaaaaaaaaaaaaaaaaaaaaaaaattgggagaacttcagtaaactgggaaaaagaggaggtattaaaaacgtgagaataggccgggcacggtggttcatgcctgtaatcccacccagcactttgggaggttgaggtgggcggatcacctaaggtcaaaagtttgagacaagcctagccaacatggcaaaacctggtctctactaaaaatacaaaaattagctgggggtggtgttgggtgcctgtaatcccagctactcgggaggctgaggcaggagaattgcttgaacccaggaggtgggggttacagtgagctgagatcacgccactgcactccagcctgggagacagagctagactctgtcttggaaaaaagaaaaggtgagaataatagcatgagccaaaaaacaaaaggtacaaaatatattctgggaataagtacaatttatcttaatttcgtagagtattcatagttttcaaagtgctttcacataagctatgttgtgtatggaaattagagcaatcatatgcaggtgtatagaaaaagtattatttattgtccatatgaagaaagtgagttttggaaaagataaatgacatatatatatatggttatcaaatagcacaatttaatagatttagcaaatttactgaaattagtaaattggacttaagaagaaattgtgaaggttcctctggtaagagtgcacaagagaaaattcaaggaggatagcagttagcaggatcctgacatagtccagctgaaatgtagcaagggtctgcactagggtaggcttgcttgcaatgttgtgggctctttttacagacaatgtagatacacagcgtatgcgagtttgcttttgattggacgtaagaagcaagatcaaagagatataccaaaggactcagaggctagtcacatataaacaaaatctgggccaggtgcagtggctcatgcctgtaatcccagcactttgggaggcaaggcgggtggatcccttgaagtcaggagttcaaaaccagtctggccaacatggtgaaaccccgtctttactaaaaatacaaaaattagccaggcgtggtggtaggtgcctgtaatcccagctacatcggaggctgaggcaagagaattgcttgaacccaggaggtggaggttgcagtgagccaaggtcaggccactgcactccagccaacaaaacaaaacaaaatctgactccgcctttcagtcacgccagtgaaatctcttaatgccttcagtgtcagtccccaactcttactaattaaagatcgtatttgacccaaatgtgcacagtacacaacaccttaaagagaaatgaggtgaatcagataaatgaacaggttgatattttttaaatttgtccacaagctctttgatatccctcctttcaaatcacagcttaattcccctccccttgtgaatgcactgtatttaatgactggcttctaatgaatggaataagaagtaagttaccatagtaaactaagtaataaagggtgactaagtaataaagggcattgcagctttctccttgacttctctcttggatcacactctcagctgccatgtcattagaagagccgagctgcactatagagacacaagaggtgagaaactgaggcctcctgccaacagccatgcaagtgactcatctcggaagtggatcttttagctacaaaaagcctttggggcactttagccttggctaatattttaactgtaacctcttgagaaatgctgagccaggatgactctggctagctagactattgccaaattcctgacccacagaaactttgaaataacaaatgggataattgatgaggtaacaataaataactagtacaacgctgaaagaggagaaggtatataggacttttctccatcaaaggacagagattattgaattgaacaagggagtaaagtacaaatagtcctgaaattgatccagccaacttttgatcactaatctctccctgcaaaggaaagatttaatacttttcaaaatttcaatcaagtcttcagtatattcaaattcaactctctagtatacagatgctcctcaacttacgatggggttatgtcctgataaacccgttgtaaactgaaaatacagtaagtcgaaaatgcctttaatatatctaacctaccaaacatcatagcttcacgaggccctccttaaatgtgttcagaacacttacattagcctacagttgggaaaaatcacctaacacaaagcatattttataataaagtgttgaataatttattgactactgtactgaaaatgaaaaacagaatggctatatgagtactcaaagtacagtttctactgtgtgtcacttttgcaccatcatacagtcaaaacactgttacgctggggcatcctaagtcagcaaccacctgtgtatatgctcttgtggtttaacggcagcacagtgctatgcttatgaaatcacttagaaattgacattctgttttaatgtgtagtatttcagttttcaaaaaagaatacactttataatttacaaaactatatggagtcataaacttcatagatttatatgtatgcatgcatctttggttagggttgtgggtaaatttgaaaagctacgcattaccctcaaatttatataaacctctacgtttaacaaagcaatttcatatagctttcatcttggggcgtccccttacaaaatggatgcatgcacttaggtagggctcacttaactatctaataatggagtttttaaatatagacactagaatatattctgctgtttgttccaaaaaccctcttcttcgtttctcttatcccacccacgtccgaatatagcatgccaaaaacagagccaaaaacaagattgtctgtgacatatctgtcctgtcacagacaaggacagattaagaggaccagatcagaaaatgtgtgtatactaagtagctcaaagacaagggcaaaactttaacgcaaagaaaatacattcagagctttccaagtcccaatttcttctgcttttacagttcagcctagttagttgtcctccacgccccccgccccacgcgcgtttgcgttttcttaataaacccacagcaagacctagggcgggggtgaaccacagcgcatgcgccgtagggagcgacctcaacagctagggtgctgtttgggcggggcctgggcggggccagacgcgcgcgagatttgaatttcctctgcgtgcggtcagtgcccgcgcagcgttgagttgcacagcggtattctcaccaggccctgcaatcggtgggccacagtgccggccacagagatggtggaaggaccaggctgtactctgaatggagagaagattcgcgcgcgggtgctcccgggccaggcggtgaccggcgtgcggggaagcgctctgcggagtctgcagggccgcgccttgcggctcgcagcctccacggttgtggtctccccgcaggtgagctactcctgtaacaggccatgcagtcagcaggggggaaatggaataaagaccccatcagggttccaggatttaaagtgtcatctctttgctctggcccaggtttcctggggtcccacctttcacagagtttatcgtcactttactgtagggagaagtcggtcctagcgcgcctgcgcaggagaggagggctagcgttctgggctcacgctgccggagcaagatgccctaggggaatccagtgaaggtgttttatccgagtcaccttacttaacttctttatgatacacacatggtttcccatgtctacagctgcattttttactattgatattatcaaatctctgctacctctgatatgttttcttcgtcccattttaagcttttagcataaaattctactttcttgcttggctaatctgcaattggtaagtatatcacaactagtatataattctaaaactacacgtagaaaatttagcactaacttctcactcaacttcatattgccatctaattaaggggcaatgaaacccagttctggttcccttaagtgaatttatttctttttaaagtaaactagcacagcttcttgccactcaggcattcattgcagacgatgtggtattcatttggccagaacttgtactaaaaatattctgattaaggcatcatgttttaaaagccctctagatgtatggatgattgtatttcatgcctacatgcaatattgcactgtatttcaatttcttctgcaaagcttcttatagcctttggtcctggaagaaaaagttgcctgctatgaaattagcatatgcttacaacttgaaagaaatgaggttctaagtctaagaaaatatattttcaaacttgggaaaaaataagttttacatctccttccaattgcccttttgtttattttgacttgatatgccagtaagtactctgtacctatttttttttattattgttatagtgtttctaaaatcgtttcagggtaccacagagatggattttagatggtttcttaagaatattaatatttatgaaaattactcattcaataaaattttgaatactcaagacacctggggagcaaaaacaaatacttcctcttttggagcctatacttcagttgggaagacacaaagacattcattaaataatcacctaaagaaatataaattaataagttctgtgaaggagagatacacgattctttaaggacttgtaggaagacctgggaaggcttccccagggaagtagcaaagctgaggtgtgggccgggtgcagtggctcatgcctgtaatcccagcactttgggatgctgaggtgggcagatcgcctgaggttgggagttcaacaccagcctgaccaatatggagaaattccatccctacaaaaataaaaaattagtcaggcatgctggtgcatgcctgtaatcccagctactcaggaggctgaggcaggagaatcgcttgaatccaggaggtggaggttgcagtgagctgaggtcgcgttattgcaccccagcctgggcaacaagagcgaaactctgtctcaaaaaaaaaaaaaaaaaaaaagctgaggtgtgcagggtgagtagaagccatgcagctcagggattggaacaggaaaaagactgaaagaaagccagagtagacactgccctctcatttaggagtcgactgcagaaatccaggtgacaaatttggggtcaagtgctggtggtggagatgaagacaagagaatcactatgatgggagggctaagcaatggatatgacatgaatatacttagggatatcatcatttacatcattcaaccacaacgtattttgtgttaggttttatgctagctcctgcggatacgaagatgagtaggatatgctttctgctgtgagagtccaacctaatgttttaaataaatatcacctcattggtatttaggaaaaatagcttaaacatttccttttaagttttgttgtgattatctctgatggtatggcatgagatgcttttacatttcattcagtcatgaaaaaggataaccctatgataaaggattaacctgattctacagatgaggcatatgaggctcagagtgactttaagtaaatttgcccaagatcacatgtctagtaaggggctaaaccagggtttgatttttctttaaaactccaaagcctaccctcttaaccatgccatagctcctctcagccataaaagattcagtaggatctttattgcttttttagcatacaacggtaagaacaccataatgctcagtatatagtagtggttatttattaaatagaaaagtgcaatcttggatttttggctgtgtctaccaccatttttagttttgttcggttgagtcaattctcttatatctattctgataattctcttctaacagcttctatggccatgtttggattgcacaaaagagtgcagcctgataatataatacaaatgcgtcagtaatggttaggcaattattaacatcacttggcagcaatattcaataagttataccccacacataaaaagcctggcatttaaaggtattatttttgataccttgatagaaagaggcattaaaaattggaataggtctttgtggttagtatcaggaatctggttctatggacactggattttaaaatcaatatggaaggaatacattctttgaggctgttggtaaatttctaaataatttactatggcttcattttctgggactttgatctgaaaaaaaaaacataattataaccttttgtaaacatgaagagtcttttgcattttagagggatccatagtaaatttcattaaaacatggtaggttgtcacaaacctctggcaagatcattactgtagcagatgatcccatgtctcctaggcatttatgccaaagagttaaagctatttaaatgtttctgctactggcttgaaatgattagttttcacaaggcagcatttaaaaataatttaataactgcatactgcattctttacagtgcagtaaacatggaaaaagttactaatgagagctaaagaaatatttaatgggcattcaaaataaaatatttaaacctcagataatcataccaaaaaacaaaccaaaaaacactacttcagtagttattgccataatggactgttactgtgtcatatagcattcctctttgttacagtataaagtttatagagaacacacttgaatgcatgtctgcctgtgacaactgatcctcattttgagaaaacctagccatagaagatcccagcatctgctagtcatggatgtactatattatttttctgagtcgtgatccactgtcttgtcagcataaaattgtgcaacagtataagcaaattgcataaaactctgctggagattgtggaaacttatggtaagaaacaatattggaatataaatgaacatatctggttaatgagctttgaagagtcaatcctttgattttaattgttgggtggatacaatattttagtgaaatcatatttaatctgcatgtgttttcaatctcacaaaacaggatatgaaacagtttataagcattcattttatttgaaacatggtctgattatttccatcactccttaaaatttgatacatgtatttaatatgccagctatttatcgttatatatgcttcacagtgtcaggaactgaggagacatttaataaaagttgaatggatggagaagaacaaggttttgaatagtgcaaagtgattaaagatttagaaataaattccatttggactctttcattatgagaatgtgtatattttgttgtgcatgttatatggaaattcctactaccagaatataaaccaggtagtaaattttccttcttcaaagtgggggaaaaaaatcgtggctcattttattgccattatttaaagaaatgagctaatctacagagattcattttccagcaaaatgaggctcatttctttaagcatctgaaggggatttctaaataatttagagaacatgcattatatacttccttaccttcttaaatggatactaataatgatttatccttaatgactcaagatcatcattattggtatccagaatcctatggaatcatgaaacaagggataacaaagaacagaaacattcttacaaaggaggaaaaaggggaggtgattttccatggccattgtagctttttatccaagatgaacatattcggcatgctgcagagaagagagcatctgatcatcttgattttgaattcccatttttttgttacttcctcgtctggagatgcttattgttgcatcttagcttatttggtcaggattaaattaagcagcatgtaaaattcttagcttagtacctagcaaaataaacatcctgggaattgttcctttttcttctggatcagagctttctcaccagacccatttatctgaggaacaccctatttttatgaagggtttgtaatcatttggtgccttcagataaggtacaaagtctttagtctgagtaagtgcttgaaggtcctgcacttagaaaattgtagaatatgtttttgatgaatgggcctgaggacctctattttgttgtttagaaatcactttaaaattatattctttgatgacttcgattggtatttaagagatctctgattaaaaagtgttgttgtaggccgggcgcggtggctcacacctgtaattccagcactttgggaggctgaggcgggcagatcacgaggtcaggagattgagaccattctggctaacacagtgaaaccccgtatctactaaaaatacaaaaaattagcttggtggacgcctgtagtcccagctactcgggaggctgaggcaggagaatggcgtgaacccaggaggtggagcttgcagtgagccgagatcgcgccactgcactcgagcctgggcaacagagcgagactccgtctcaaaaaaaaaaaaaaaaaaaaatgtgttgttgtactggggggaaaagtgtgtgaggaaaagaggagagagtatgaaagtaaatatggtattttcttctctatagggaaaatacttaactgcactagggttgaaacatttatctatggaaaagtcttattctgctctaaaaagtttgtctttcttgtccatccatggataggcaggataaatggtaatcagcacaataaatcatgtgctgtctctgaaaatacatgttgttttgaagatttcatattattaagccacttgaaaatgggaaggtgaacccttctcaatcatacctaaacttgtgtcaaaggagattttcgtctttatttcagaaaaaactaaaaaggatgaaatgttcaaataatacagtaatggattataagggtcaacatgggaaagtcaagtgtatattggacaattacgtatagtcatagcaaagataacaggcttatggaaattagtttttgaatttgggcagcaaaagcttgtagagagcagtgataaccctagattctatggtaggacaagtgaatatcttataaatcttaggtttattgcaaaaaccttgcccagtttgtacacaatagctcttaaaacaagtagaacaaaccattaccagtataccagaattttaccttaagatggatttttaaaagaacagtgaaagatatatccaggtgcttgcaatggccaattgtaagttgaaaattttattttatcccaagtatattatccagagctgattattttagaaatgatagagtaccaggaatccgctgacttgggtaaaccatctgcatgatagacaactgaataaaaaaatcttgatgtgtcatttcaaaaccaaaattaagcacagtagtaccacctgtccacagaaggtgcatttaaagacacccagcgaatgccagaaaccatgcatagtatcgaaccctatatatgctatcttttttcctatacatacaacctatgttagtttaatttataaattaggtacagtaggagattaatagcaataactaataatagaacagttatgacatactgtaataaaagttaatgtggtatctctctctctcaaaatatcttatggtactgtaccgtgagtaactgaaactacagaaagtgaaaccttggataggggagaactactgtattggattagatctttttagagcaacaatttaaatgctaagtaaacttgtcaaataaaaaccaggcattctaggactggttgctaaacacagaggaactcctccctaaaccttcccatatggttcatttaattttatgggaaattctggtaagtagagtattttacttccattatagcttctagtagtcatgaggatttggtcctcctatgtttaaatctcactccattgcaggtaattagaaaataagatattgggatgttaatgaattttaaaaggagattaagtagatggtagagtagaagattttgccaagatatcttgggaagagtcaagcaggatggggatggtgggaggggaagaagtgaatgtatattttaaagccacacttggttttcagagctaaaggaggaggcatctatttaatcccacaaatgtgcactgaacctcaggcattgtgtaaagccatcaaggatattagctaaacttgttactgtccccagagagcttatagacaggggagaaatgcaagtcacagacaagtaataattcagtatagtaagtactatgacagtggtttagaaaatactatgcgaaatttggcaggtagaaagcctcaagattatcctactgtccaggtggggaaaccctaggcccagagagaattacagactatatatgtgagcaaggaagaggttttactaacattgcattttaatacccaaataccatcgggtattaaaaaaggaattcttaaacatattcaagccaaggtcatatagcatctgtacctagaagagtttctgctgcactgaagtcatttgatatttttaggttaatgtttttctataagttaatatctaccttgaattccttcacttgctcttctgtcaacatgtatgttacaatattaacattcatcaggcgataaacatcttttttcaacattggtaatttcagagttttcattttttaaagatcatattgtatgttgtttttaattgcagagaatagggtgaaacaccagtagagcaaataagacgtgtattacacctttaagactttagttggaggttctctttgaagctctgtcagctaggacaacatatttcaatttccattgacagccatgtgaagatatataatggtctcatgcattttaagtatattgggggctttgtatttttgactccttttcctttcacaacagagtttatttacaagggaacgtattaccttttttcttgttaataagtggcgcagtaaacataaggtttgaagaactagccaccaaaactttgttttgctaaatggccacatcattttccacggttagaactttcttttcttttttttttttttttttttttttgagatggagtcttgctctgtcacccaggctgcagtgctgttgagagatcagctcactgcagcctccacctcctgggttcaagcgattctcctgcctcagcctcccaaatagctgggattacaggcatgcaccactagacctggttaatttttgtgtttttagtagagttttcatcatgttggtcagtctggtctcaaactcctgacctcaggtgatccgcctgcctcggcctcccaaagtgctggaattacaggcaccgtgcctggccaccatggttagaacttgctaaaatctctgatagatgacagtaggtttgcagatatagatgtctgctccaggataacctttgatgccttgaggcataaatcctggaaataataaaaacttctttcaaaaaaacctatccctcagcattggttatgagggacgtttcagccgttcttttcataaactgtacatggaactatattccccacagtgtaggttctatagaatcttgaggcaggatcttataggctcatttaccacataggaattccctgggggaaaatctctggtagaaatcaggatggctagttttgagtctcttcctaatgaatattattaggagtcctaagcattttaatattggggtaaaaagaagttgaggtttccattaagaacccttacttttgtcagttttttcctgtttgttttttcaattgatctcacctgaaatgtatgtcatatggtggtttgaggttaaatgatacaaaaaattttacacattatttctgtaagtattttggtttgccagttacaacaaaactcaatggggcagtgctgctgaattagatttgggcgttttgataatggggcagttgtcttcatggagtagaaaacttccccaggaaattggcaaagttttcagaactgatagagtaaaatcagaaaatctatctactactcttcctcttgttctctgggccatggcatacaagggcctttgctctgtcattccttttgcctggatcatggctcacttatttaaaacttgcccaaatttcaattccttgatgaaattatgactgctcctttaaaattgcaacccgttgcaccctcccccaatcttgctctctccttttcatctccatttcttttccgaatgttctaacatactgtgttattgtgtttattgcctactctttttctactctttttccttactagaacataaactccacgagggcagctggttttagttgttttatttatggatgcatcccaagcatctagaacaaggcctgacacatagtggaaggtcagtaaacttttctaaaatgagtttatccaggtaaacagccatttttaatggggaggaggatcatctttccagatgtcacgtgccacttttgttgtagacaaagccaggtgaataacatgaactgttacaggtgttggcttttggagtttttaactaaatggtgtaagttcttgtcaaagctgttaacttggtgatgtgagcagacttcacatgagacatttgggactcgtgtactgtcttattaggtgttgtgacagcactgtctatttcaaggttacttctctgtctctttgctagtagccattataaaacctggtaaagtcagaactaagcagaagaaagaaggtccaggtagggagaagacaagtagtgagtgcaggccagtcagatggtttcccatcttggaagaagggaagagagccagtcaggtgcactgagaagcagtgatatggtagctgacataggatttcataattggccaatcggacattagatagatgttgagtttcagctttaactttttttaatttcttatttttaattacagtaggcttttgggggaacaagtggtgtttggttacaaggataagttctttagtggtgatttctgagattttggtgcccccatcacctgggcaatgcacactatacccaatgtgtagtcttttatccctcacgcccctctgtccctccccgcaagtccccaaagtgtaatgtgtcattcttatgcctttacatcagatgtaacttataaaacctaaaggggtaaaggagattaaagcacaggagtggcagtagtagcaaattctttcctaccgaagaagcagggaacgctactatatatgagagagagagaagggtgtgtgtgtgtgtaaaatgggataatattcatcacctggcctctgctgggagctctaagaaaagctagaaaatttcacagggtatggctaaaacaagttgctagtaaagaatgttggaaaaagataagagattgttgacattggagtggtggggaaacaaggctctcaccattgacttataaatgtgggtttaaaatgttagtaagaacttaaatctgagatcctgaaaatgtacaacctaatctatattgagacaaagatctatatctgctttgtatatcatcatcttaaaagtgtcctggcaagtttataggaactttttacatactaattggttgtcatggaaacctaccttaaaacccactattgtaatctatacttggcctgaagtgtatttaagtgacttaaagtctcctgttaaggagaaaagcatcaagattcttggtgtttgtcaattcagggctctaaaagattgacttatataaaaagaaggcaaatgtgttttttcctcactgagtactcaagcctgccttcccagtgcttgataattattgataggtactagagttcatcccagaaagggcaaccaaagactgagctttgaggacatggtggcatatacctacagtctccaacaggttctttttttgtgatttgtgcagaacaggaagtgactgctgtctttttttttttttttttttttttttttttgaaacggagtctcgctgtgtctcccaggctggtgtgcagtggcgtgatctcggctcactgcaagctccacctccagggttcacgccattctcctgactcagcctcccgagtagctggggctacaggcgcccgccaccatgcccggctaattttttttgtatttttagtagagacagggtttcacggtggtctcgatctcctgacctcgtgatccgcccgcctcgacctcccaaagtgctgagattacaggcgtgagccaccgcgccgggcctgctgtcatttttaattactcctgtgcatttaatttatctgtcattctaagccagtgattgattctccagttcttaaacaaaggagggatatataaagccagtcgcctgaacttcaggcagttggaaaattctggcattgactgtagctatttcaaccttgaatgggtttagtggaagaatagtgtctgtctcttttttttttttttctttatctccctgttatctctctttgagctaagtactgtgattgtatcttaacaaagaccaatttagtgaaataaagaatagagtggacatgtcatcttaagcatttagaatgacaaatgtctgtaaaatcaaaagtttgagaatcactgaacaatatcatttcactctaaattgaggaaaaattgtgacttgtttctagactctgtatctaaagctgttttataattatatcttgacatttccccactcccactgcccaccaaggtttcgttcagaatcttctgaggatccttaggcccatttgagaaaaacacaaaagaagttagaggtaaatgaggatattaccttagactgagttaatgcgtagatgtaattctgtgtaccctattttatcttatataataattacgcatgtcttaagttttacatttttattacattttgagtttaaattaaataatgtttataaaacatatataaataataaaaaataatgacataagaaacaccagtatacataatgctcagtttaagaaaaagggcattactaaaatctaaaccaaacgccctttcttttcttctcccacagaagaacctacattttatatttttgttttctgtttaattcatgtttataatttcctcgaatatcttataggattctgcctatatgttgtcattctaacaatatattgtttggttttgcaaggctgatgggggaaagggaatatgagtttattttttctttattcttaacattgtgcttggaataggacaggtctcaaattagattcccctactcagggggccgcaggtttttatctctgatctcctgcaccctcacaagatgtgaaaattgaagctctcattccttagtttcatgtgaaaattgaagctctcattccttagtttcaatcaatgcccttaggatagatgctggcttcacagctctccctactacctctcagggttctctcccgcttttagtttttgaccttttattatttcatactagcttaaaagttcatcggtgaagttaaaaatattttgttttcatattttatcatctgtcatttgtagctgtttttatctgaccactctttcagggaacttggctatatacttctggaaatggaagaacctatattccagtttttagttttagaacattcgtgttgtattcctatgctttcttttcatatgcacagagctatatggtcctggaagaaactttattttgcttgtctaccaattactttttttcacttaatttttttggcctctctctctttaaatgactgcatagtgatttgacaaaatgtatgtaaacagccgattacattacatgacttgttggagattattcttctcattggaatgcacctgggcgtgaagtaatataaacacatttaagaattaaataatgcttttgcttagagtttgtgtgtgtgtgtgcttatgtgtgtacatgtattttccactaggctgctgcactgaataatgattccagccagaatgtcttgagcctgtttaatggatatgtttacagtggcgtggaaactttggggaaggagctctttatgtactttggaccaaaagctttacggtaagataagcctgtacgatacatcttatctctctatatttaaagatgcgtagaaggctagatggagtttgccgggtgtcacatttaatcatataggaagtactgtgtttttaagagagctccaatatgagaggttgtgattctatcatggaaatcaataaacagcagaagaataaattctgatgtcatcatcacttggaagacagtcattttacagggcttcccaagatgtattagagcaacacatctgttttgctagtccccaagcttcctataccacaagtctctccttgtttttaccgaatgcttattgtattcagtgacatcggttactttatatttgtgacaggccctagtttggtttaaatgtatcacttgatctttaaatatttttctggcttcctgctttctctgaagccttgaatggaatttggaaatttacttagagagtgtaaaaactttccagagaaataacaggttctccattgtttcacagttcccatggaaattcatggctaatatactggcagagaaggactagcaacctatttcctttgttgacttaatgataaaaaagtcaaaatatatgtaattgtgatgcatgatcacatgtttaatttttgcaggaaaatgaaagcggcctttgagttaatatgtctacccaatctcattctgtcttttctgagtttagcctaagcttttgccaactgtaaaaattgatactgcttcctcaaatcgtttttagtgctgtttaaagatactgaccacagttatcacctttttcttaaaagaaaagacctgttcctggaccccatgctaaccaaaggtgaataattgtcacaaagagatgatactatatgattgttctttattgcatctcatctaccacatatttagagtaatccagggtttatgtaattgcttttcctttgaggtgttctcttttcattgtcagcagctgctgtccttggacaacattgtcacttcatggttttgcttagtctggaattgataacatcagcatatgcctagttgttcatgcagtaatgatatattgcaggttacactgctgctgtagtagactgatgtgatggaaaactcatagctctggatagagtagtacacaatgggatctatgcacgatagttgaaaacattgatatgttattgattctctggtgttaggtacagatttatttctgtaagatgagagggggtttttatcaagtgctctccaccagactgataagggggaagtcatttctcagcacacggctgtcagtaagtgttccatgaagttctaaacaaggacaatcacttcttcaaactcattgaactagtgccctccctggagagtacctatgtcagtatatgggtgggaaaaatgcagtggcttgcttcctttcagtttcctgcagccataacaactattggatgtaacaattcaaggtcaatggcagatctgctgttggaatctgaacctaaaatcatttgcccctcttttcacaatgtaacagaagttcaaaaaatgtacttccaacctgtgcttcttagaggaatggataactctctcaaagaaatgtgatctttttgtgaggctgcaggtctgtgcacctgcaatagaaatgtagtcttcatttttgacttctgcctcccacccacctggctcatctgcatttgatagagcatatagcaggaaacactttcaaaggttgctcacagttttcccttgatacccaacttttcacaagcaaaattgcccgcagagtttagtcataaagtgtgtgcatctcataggttgggccatgaatctcctgggattcattggttgaatctcctgggattcatttgttaatgaaagtagaatacgagcatagcctctaaaagaatctgccctgtaaaaatccacacatcagaaagatacaaattagagagtgattacttctctacctactaagtgatatattcaagtgctcctgatagtgccaaggaatactaaaaattatttgatacacatttattttaggagcactattgtgttatgtgtgattaatacctgtacaacttctgaacactttccactaactcttcaactaaaacaacacaaacgtcacttgaagtttttgctacaaatgtaacaagtactcagtagagaaaactgaaaaataatgaaaataagtgtaaagtaatacattctcaatcccactaccaggtgtaatctttattaactttggatgcatacaatgccacattgccagtatagtgtgtgcgaatgtttatatgcatgttcacccagctgcactcacactgaagctatcattttaatcaaaatggacatagctgttgcattttggactaaaatttaaaaaacagatagatagatagatagatagatagatagatagataagtaaatatatttttccaagaccattttctgtttccagtttgtgatttacatgactctggcttttgaagttatatgtgctcagagaccagaaactatatctgagatattttggaggctttgccattttagaaatgccttatacatgattgattttataatttattggggtttaagtatgaacctcaaaccagttatgcaagagataatataatgattctttttagtttgctgaaatgtctttattgaatccatcatatattacttataaaagagttttacagcttcaacatagtttctgtactatcatataacatgttaggagaaatagaagtgtacttttactctgtataatactttaagattcattcatactgtttgaagtatcagtggtactttcttttcttttactaagtagtctcccattgtatgaacataccatattttgttaattcattcatcagatgatggacatttggattgtttcaagtttttaatattgtgaataaaattgctatgaatattcacatacatatgacatatatatgtggacatacattttcatttctcttggataaattaccaaatgacttagaaattctaagtcatttggtaagcatatgtttgactttaagaggaattgccaaactgttcttaaaagtggtggtaccattttacattctcaccagcagagtatgagaatttcagttactcagcatctttgccagcacctggtattgtcagttgtgttaatttcagctattctaataggtgtacagtgtatctcactatgattttaattttcttctccctactaactaatgatatctgatgcaatatgcatatttcctgtttgtgtattttatagggtgatgtgtctattaatgttttccttttttattggatatatttttgtattattgagttatagtattctgtatatattctagatgtcagtcatttatcagataacatgttttgcaagtattttctcccaatctatggcttttctcttcattttcttaaccatatctcttcaagattaaaaacttttaagtttgatgaaacctaatttatcaaatttttttttcatggttcattcatacgttttgtgaccagtctaagaaacatctgcctaatgcaaattaatcaacatttccttgtttgttttcttctggaagttttattgagttagctcttctgtttaggattatgatctattttgagttcttttttgtatatggtacaaggcaggagctggactttgtctttttgcgtgtgtattttccagcaccattgttgacgagattatcctttctccattgaatttctttgcaactttgttgaaaattagttgaccatatatgtatgggtctatttctgaactctgcattcagaagaatatcagataaagtgatattcttttatcattttttgtgtctgtcctttcaccaataatacactgtcttaattaaagtagctttaaagtcagtttaaattaagtagtgtcagtcgtctgactttattctttttttttttcaaaattgtttttgttgttttagttatctttctacattttagacttagcttgttgatttctacagagttctttctggcattttgattggccttgtgttggatctatagatcaattaggtgataattcacatgctaacattattgtcttccactccatgaacacagtatatattaatatgtatttagatcttccttcatttctttatcagtattttgtaattttcagcttcagacatattttatatttgtaactaagtgggtttttttggagctattgtaaagggtacttttttaaaatttgaatttctaattgttcatttgcagtgtatggaaatacaatttttgtgtgtatattgaccttgtatcctgcaaccttgctgatatgatctggctctgtgttcccacccagatttcatcttgaattgtaattcccatgtgtcgaggtgtgggggggcatgtaatccccttgtgtcaagggaaagaggcgactggatcatgggggctgtttcccccatgctgttcttgtgatagtgagtgagttctcactagatctcttggttttataaggggctcttcccccttctctttctcttctctctcctgctgccatctgaagaaggtccttgcttccttttcaccttccaccatgattgtaagtttcctgagacctcccaaaccatgtggaactgcgagtcaattaagcctctttcctttataaattatccagtctcagggaagttctttacagcagtgtaaaaacagactaatacacttgctaaactcgttatagttctagtcgctttttcttgtatacttttagtattttctatgtagataatcatatcatctgtgaattaaagcagttttattttttcctttctgatctatatgacttttttaaaaaaaatttacttcaagttctaggatacatgtgcagaacatgcaggtttgttacataggtgtacatgtgccatggtggtttgctgcacctatcaacctgtcatctaggttttaagcctcgcatgcattaagtgtttgtcctaatgctctccctctccttgtcccccacaccctatatgccttttatttctttttcttgttttattgcactggccaggacccccagcatgatgttgagtagtagtggtgagagcaaataagtttgccttgttgtctgtgatattagctttattttcttttattaaatcaaaaaatttcccttttatttctaatttgttgaatttttcaagtattttttctgcatctattgagatcatcatattgcctttcttacttcatttgtttatgtgtggaattctatattgattgatttttaaattttgaatgagccttgcattcctggaatatactccactttgtcatgatggattgtcctttctatatgtttctggattcgattagttaatattttattgaggacttttgcttgtgtcttcataagagatattgcactatggtgttatttttctgttactgcctttgtctaattttggtattagggtaatgatggcctccaactgagtttcatctgatattccagaaacatttgtgtagatttgttattggtataacatcaactggtctgatgtatttggagttccagaaaggaaagagaaaaaaacaaaacagaagacatttttaaaagaagtaatggccaagaattgtgcaggattaacaaagctatggaacaaggtgacataatctaacattcttgtaactgtcatcctagaagaaagaaagaacagaacagaagacatctttggatttaaatggccaagaattttcttaacaaaccacagatccaagaagctaaaagagcctcaaaccaaaccaaatgtccctcacacgtacctagccaatgtgctaaaaaccaaagatgaagagaaagtgctggaagcagagaaaaagaaacattgcatattaatacaaaggaacaaagctaagaaatacatttacagaaattatgtaagacagaagacaacagagcaacgtttgctgaaagaaaaacctctcaactcagaattctaaacccatctaatatatctattaaaaatgaaggtataataaagactttttcgaaaaaaagaagctaagagaatgtagtagcaggagacctgcagtgcaagaaaagttaaagtctgtccagcataagggatataataacagacagaaatctgaactacagaaagaaaaaactgggaatgggaaacttggaagtaaatataaaagatgtttttctgttatgttctatatctaaagcaagcataataacaatttattgtggactttataacatatgtcagagtaaaatgcattgcaacaatagtacaaatgagataggaaaatgatggtacactaatgttgttgcaatatacgttttgcatatcatttgaagatatgcatatcatttgaagatatcactgagataacttgtatctcagtaatatacgttttgcatatcatttgaagatttgcatatcgtttgaatatatcactgagataacttgtatcacagtgtaagatgtgtattataaaacctagagcaactacttaaaaaaattcaaaaagtggtaaaagtaataagctgctatggagataaaatagaagttttaaaaatgctcaatccaaaagaatgcattaaaagatgaacaaagaacagatggaacaaatagaaaacaatagtaatacagtatatttaaatcaaagcataaaaataatcacattaaatataaataatctaaccatcccaattatttggcagaaattaattgaataaaaacacaagacccaactataatgtgcctataagaaaaccacttaaaatataatgatgcaggttaaaataaaaggatggaaacagaaatactatggaaacacttatcaaaagaaagctggagtagctagaataaaatcaaagtagatttcagatcaaggaatattactgagggtaaagaaggacattaaaaaaagattaaggggttaattcatcaagaaaatgtagtaatcctaatagaaattcaaaagatgtaaagcaagaactgctagaatggaaagggcaaagagaaactaatattgttgaataattcaacactctcttgtcagtaactgatagaacaagtgggcaaaaatcagcaaggataaaagacctgagcaacactatcaaccaccttgacctaattgacaagtagagaacattccacccaacaacacatgcttttcaagtgcatgtggaacacttagcaagattgaccagattatggacagcaaaatgagtcttaacaaatttaaaagtattgatatcatggaagaatcctctctgactacaacagaattaaactagaaattattgagatacctagaaaaatcttttttttttttctttttcaaatggagtcttgctctgtcacccagactggagtacagtggagggatctctgctcattgcagcctctacctcccgggttcaagtgattctcctgcctcagcttcttgagtagctgggattacagacgcctgctaccatgcctggctaatttttatatttttagtggagacggcgtttcaccacgttgcccaggctggtctcaaactcctgacctcaggtcatctacccgccttggcctcccaaagtgctgggattacaggcgtgagccactgcgcccagctgaaaaatttaaagtatttggaaatcaatgtgcttctaaactcacctgtcaaataaatcacaaaggaacttagaacatattttgaactgaatgaaaatgaaaacgccagatcaaaatttgtaggagacagctaaagcaatgcttgaggaaatgttctggcattaaatgttttttataaatgaataaaattctctaagatttaagcttccatataaaaaactagaagaataagagctaattaaacccaaaacagacagaaggacggaaataatgaagataagaacagaaatcaatggaatttaaaaatgaaagcaatagagaaaaaaaatcaatgaagcaaataattggtcctttgaaaagcataataaaaatgaatgacaccaaaaattggttctttgaaaaatgtaataaaaatgataaacttttagctcaatgcagtccaatataaacatgggagacatatatataatttaaaatcttccaatagctgcattaaccaaagcaaaaagaaatcaattttaataatgtattttattaacctatacaaaatatttcaacatataaacaatataagcaattattgataagctatgtaactttttttatactaagtcttcaaaatctactgtgtattttataattagagtacacattaatttgaactaataacatttccagtgctcacttgccacatgtgggtagtggctgccatattggacaatacagctcacatataaacactatgaggaatgacaaagggaacattactgcagatcctcaagttgttatttgaatagaaataggacactatatattacctaacaaatttatgtcgatgaattcaacaactaaaataaatggacagattccttgaaagacacaaattatcaaaacatactctagaactaaagtaaaaatatgagttattttctatgttttaaataagttgagttgatagtttaaaacttctcaagaaagaaaaccccaggcatatttaaggaacatgctctgttttatctttttcatccttttttctctttcttaggtttggataatttctattaatctatattcaggttcacttattctttcctctgctctgtgcggtctgctggtctgctcattgaagaaatgtcttctccctgctatcatgtattttggtttctctgctgaaatatcacacctgttcatgtgcctttatactagatccttacatatgttaaatcattaacatattaataactaatatataatataaaatttgattaagaatcaatattttaagtttaaaattaatttaacattacttttaaatcacctgtctcatagatatgacatctggtgcatctttgggtctggctctgttgactgctttatctcttgatatatttatctcttgatacttttttaatctttgtgtgtatatatgtgtcttatcatttttttgaatcctagacattgtctatagaagacaaaaagctaaatcccagacaccatgtatagacatataagagctaaataatatttaagctcagaaacagtcatgcctcttctgtcagtcattagtgtcagggattgagtgagtctagtaaagtagttgaccttcgtttgagttttgctttgtttgggttggcttcagtgcaccaacaacttcaaaactccagctgctactgctactttatgccttgtgtgtggtctggtttggcagtggatggtttctctgtgttgctgctcgactctcagctttcagcacatcttgcatattcatgtcacagagaaagtctctccatgttcttacctctccaccatgtagactgctgtcgcttgtgactcagtgggaggcttatgatggggatagtggggatatttacttctggattagcctggaacttgggcaggcctttgtgtatgtagaacccaaggtcgcagttttcttagggttgctgtcccttgccctcctatggcagccaaactctgccttgcacctgtgggtgtacttgggtcagagagcttcctacctcttttctggtggaagcagatttctctttgtatcatcacagtattttgtgccaaagccgattttctgtttcaactctagggacagatggcttttgcttctacctcaccttcaacaggccagggtacctttgcttgggctgggtggccgaagggtttccgctgctgtcctgtggcagactgcttatggttgttattcagtataagacatattgtttgggcagaggaagtttcctgttcctccctcaaggacagatatgacctttgtttctacctctcccttggccccagcagcttaaagactttttaagacttggacttcatctcaaagaagtgttcaagaagcagacagagtttcatgaagacaggtgtcatgccaccaagagcagctctttcaggtctcttgctgtcactcacatctttcacatgggcccacgagtgtgtattctccttgtgtctggggctccggggattctaaactgttacaccagcccacattcagtatgtaaaagtttgttgaaaattttgcagttttctgctttcccatttttatagtagccttctcttcctcttgtgctctgccacaggtgaaacaatttgtgtattctgactttactttccatggcggggcttgtcacattttggaatttagcttacctggttgcgttgcaatctcatgtctctgatgggcttaagaaaatgtatgattttgtagataacgtgattttttttctccttgttggagcggtagctatgttcactttcagccttctgcatcctaagtagtagcagaactcctattttttatttttagcattgttaaaaccatatctttttacattcttttttttttaattcccagcataggttttacaactattatattctacattttccactctttattacccttaggacacttctgaccacttgaaaatttttataggcagttgccttatttgcaaaatgtagttgtcattaatgtgaaactgtgacagtactgctttgtttatgctatttgtgcttgcttaaggatgttcagattattctgacagtgatagcttggagaatacggctgattcttaaaacaggatcagggcttatttactagtttctttaggaagatatttctaatgagaggaattttcttactgttaattgaatttttagtttgggcacattttcatattagaacttggttgcaagtgacagaggcccaactcaagcaggttcaataattatttattatcttttgttgactttggcaccaaaaacttctttaaaatttaaaaaagtgtatgaagtatcttacaaaacctgaagagaatacaggcaggcttcaaggagaactaaagcaagcaaagactaaaagctgttaggattcctcttcatttcttcactctgctcctcactgaaatcttctatagtcttcctctttgcagggagaccttcctttgctttgctggtgctcacatcgggaatcattcccatagacagctctcatatgagatctcttaatgctagcaggatctccttgggtcctacgtctttaaattcatcagaaaaattgacgaacccagcttggatactgatggatctagcttgggacaggtgtccatttctgaatcaactgtatcaaaggcacaggatctgagaaaacgacagagacctgttcaggttaagcctgaacaggttaatgcccacccttggaccaggcaactgtggttggcaggtagacttctattatgcagagtgaattgtcttgggtaaccttttgggttggtagaaggagcttgagatagaaataaggatctgataaaagtttcctaaactaattaattatgaggaatcctgaaaagcaaatgaaaccctaaaaatgtcttttctttatgtaatatgggcctatgtcctggtttaaaaaaaaaaaaaatcagtatcaattgttgtcgcagtatagatgtttactgtgcctcaaatattttcatgatactgatacattttttatagtttaagatcaaaggtacttagtaataaacccacgagatgtgttggtttattggggctcaattataatatctatttaataaaacaaaataaataaaaatttaaaaaaacattttatgcacttttttcctaaaaatgaattgatttataagtcagagccatacttatttgatctaaggttcttgctggggctactcctgcatttgaattgggtcttaacctttgagattttttatgtggatgtggtttcattatagaaagtgatttagaatccactttatgagccatgcagctgaaaagattttagatatgatggcttctgggcatgacagttgtacacctttcactggggttgaacttccataagttaaattatggagtacttacaggcacacatttttcctgtcaagaactatggggcatgtaaaatgcatttatgattgatagtagggcacacagagtttaaaacccacatttttaaagttagactggttaaccttgtacaatactataacatggtgctccgcaattagaagcacagagcagtagcattcgctgccaaaagagccatatttatgaactcaacaaagctatgaggagaaggatttgaaaggcggatcacagtatttcatcttgagaatcatttttgatcttcatcatcagaggtcttacagaactactttttttaaaaactggacatgctaatcaatcctataaaatctgaaaggttacgaatttttcatcgctgccttgtggctttcaagttaaccgtaaatatttataaatctcctcttcccaatacatatagaggtaaaagaaaacgaaaagaattgaggacaatagcattttgacttgttctctctttttttttgatacgtaagattttgcaaaaataaaaaaaattgtttcattgcctagtgcaaaacaaggggggaaaagagcatcttaaaccatagatattattttgcaataggtaattatttccaatccattgtggttagaaataaggaatttgaatattagtggctttgtagaatttatgaaaacacaaactataggcaacttaaacttagccttatctcatcccaagcctttgaatctgagaaaatgccaagagatgctagactgttccatgaataaaagatacttcatctgacaagaaaagaggagcaggggtgtatttttttgggcttattgttggtaccatattatttctttgagaagttattttacttttgagttgaaaaactgattgtcatgtcttctatctttataaggatacaaagtcatgagagaaaaatatataataatcttaccactggtttctgccctttaaaagtgtctatcctgactaacatttgtttgcttataatccaaaaaaaaaatgatagtacaggaaaaaagcttgataaatgatatactttctgccactcaaaaatggtttgattttgtttcaggattcatttcggaatgaaaggcttcatcatgattaatccacttgagtataaatataaaaatggagcttctcctgttttggaagtgcagctcaccaaagatttgatttgtttctttgactcatcagtagaactcaggtaaaaaaaattaaataaaagtacttacgctgcaatactgcagagcttggtttgggatgtcacacgtgtaactaaagaaacaaataaataaagagtttgtaattgatgaaacctcattttaaagaagccttcagataatataatttgtaaggtctttgttgtttgcatatgtaactcttataccctgattaacataaagtgcttatagcaaagctcattttaaaagacactttgtgaaattataaccagacttatgattaatgtgttttatattcctttctatagaaactcaatggaaagccaacagagaataagaatgatgaaagaattagatgtatgttcacctgaatttagtttcttgagagcagaaagtgaagttaaaaaacagaaaggccggatgctaggtgatgtgctaatggatcagaacgtattgcctggagtagggaacatcatcaaaaatgaagctctctttgacagtggtctccacccagctgttaaagtaagttttaagtatttttttaattatctgttgatttttcggtactgtgaaggaaccaacgtggaagccttaactctgcatttcagtaacacagtctcatcagacttcaggtgtcccgcttcccatttctacccaggtcaatttctcagtgcagccggctcctaccaccgcacttgcacttacagttgccttgtgcacaccctcccactccacatttcactctatcagtcttccttaacttgccctgctttttgttctctccataccaggtatccctttcaaacataacatatttacttattatactgattgtttaaaagctgtctccttctgctagaacacagtctcaaaaggaaacaaggcttttgttcactgaagtatcccaacatctagaacgtgacctgtggtgtatggtaggcattagatattaatatttgtggaatatgtgaatgaactaactcacaacttattttctctctctggcatattaagtacatgttctgcacacgcttgtgtattcctgattacagctgttggtgacattagaagctgctgttgtggaaggatagcaatggaaggcaggcagcagggaccaaggaataagtgatcagtgaggaaatgaaagcaaaatgtagagcccttgttcacataggccggagtgaagggaaaatattggcttgctagaggggattccagggcaagacatgagttggttattttattttttttcttgttctacaactgcagagacttgaacttatttatatgttgcaaaaaaaaaaaagtggttaaagggcagaggttaaaattgtagaaaagggaatggtgatgaatatagcaatgttctaagagggtaagagaggtgagaaccctaacccaggtagaatacatacattttagtttctagggaagacctctacattagggcttttatcaagacctgttgccactaactaaattaatttttagctcttttagctgaattattttttacataattgactctattaactaaattatcttttacataaacccaggttatttttttactttgtgtagatacttactagatagttttagtaatacccaaatcagtaggaatgaagctttaaaagaagccagttaatgataggtctagattagattctgctttttgatacttggaacacgtgagttcagtatggaaataatgaaacagaactttaacaagagtgagctttttaaaaatcacttagacctctacgaaagttgtttttgaaaaaaagagaacccagggtattgttgttatctgtgatgcactgagaatttactttttatctctgcatccagccatccatccatctaggaaatgatcatttacccataatgcctgggggtttaaaaattaatgacattggccaggcacggtggttcatgcctgtaatcccagcactttgggaggctgacgcgggcagatcacgaggtcaagaggtgagaccatcctggccaacgtggtgaaaccatcctggccaacatggtgaaaccctgtctctactaaaaacacaaaaatgaggtgggcgtagtggcacatgcctgtagtcccagctactggagaggctgaggcaggacaatcgcttaagcccgggaggcggaggttgcagtgagcagagatcacgccactgcactgcagtctggcaacagagcgagactctgtctctctctctcacacacacacacacacacacacacatttctgaaatttagctcttagcttcttaaaagcacgtgcacaattactgaaaaagtacagtttaacttttcaagatgtgacttaatatagtatgtaagatttggaaagtaataaatattttggatgtatgtaagttttaaagtttaagtgaacaattgaatatgtataatactttcaggatgactatgttgattagattttcacttctatagtcactgataagtgattttctttgtacatgtatgtgtctgtttatatgcagcttccctcagtatacacaggggatcagttgcagtactcctgcctataccaagtccatacatactgaagtcctgcagttggccctagggacactgctacacaaaaagtcagccctacacacatgcaggcttcacatctcacaaatactatatttttcattcatgtttgattgaaaaaaatctacatgtacgtggacctgctcagttcaaacctgtgtcgttgaagggtcagctgtacatatagatattcacacacaggcaacaagcatgaggcatcagagggtttcttttgggattaccattgacggcacatgtgccaaataataattctgcaagggtaacactgagatttatgttaggctgtgtcagaaaaaaattcttcagtaaggtctgtgtctgagctcttccatgtgttaataagtactttgatattaatgcatgtatagaaatgcatatcttttctaaagctcgatagtgaccttggtggtcatctactcctgtgcctattttcccttcccttctttctgttttatattgttcttggtaatttttttttttgagtccagcaagacttctcaaggtgtctgatagacaatgctgagactttgaagatgtctaatacagaataaatattcaataaatgcttgaatttacaattaaaatgtataaataggaatcatattttgtcagtaatattatcagttcaaaatataactactgttaatggtactaaatagatccgtaagaaatagagctctagaagatattcatatacgattgactcttgaacaacacaggaattggggtgctaacccctcccattgaaaatctatatacaatttttgactcttcaaaaacgtaactactaatagcctactgttgatcagaagccttactgataacatagttcacacatattctgtatgttttatgtgttacatatgtattattacaataaagtaagcttgagaaaagaaattgttattaagaatatggtaagagccaggtgtgatggtctgcgcctgtaatcccagctacctgggaggctgaggcggaaggatggctgagcccaggagtttgaagctgcagtgagctatgatgatgctgctgcactccagcctgggcaatagagtgagaccctgtctctaaaaaaacagaagaatatcataaggattatatttactactcattaagtggaagtcggtcatcataaagttattgctcctcatcatcattacattgaatagattgaggaggaagaggaggggttggtcttgctgtctcagggatggcagaggcagaaaaaaatctgcgtataagtggaccctcccagttcaaacccatgttgttcaaaggtcagctgtattcaaaatctatttacagttctctttcacagaattggcaaggcgtattatttcttacagtaatgagcaagtcatgaaactaggctctgctgttttttccacttcaaggtttgtcaattaacagatgaacagatccatcacctcatgaaaatgatacgtgatttcagcattctcttttacagggtaagagcaaaatttttcaactgtgtaaaatgtaaaatgtcagtggtttccttttggagtgcaccaaaaaatgtgaaagctgtatatagccatctagtggaaagagcatggaggtacattaagggagagtgacattatgtgggtgtaattaacatcttgaaattctaggtcataggtcagttcaaactcgtctaactataaccatattcaattatctttataccaagttaggagcagccatgttggcatttcacagactctttttctatttttggatacataaaatatagaaagtctagagaggctgacctacagtaacactttcagataaccttagttccatcaggctttgccactgactatagaccttggttcaatcaagctttgccacttactactatctgtgtggtttagattctttggataactttatttaagtttagtttcttcatctgtaaaatgggataataatgtttctctgtctaccacagttttgagaaggaaggacttgctgacttgtaaatgtggaaagttatatactatatgcatatatagaattcaataaacacatcttttaaacaaagtaatgcaaatatgtattttctttcttcacagtccattttctgtatccaaaattttcatttttactatgttcagaaagtcaggtattgtagtattctttattaattggcctaaaatgtgaatgaacctcttgctctgcagatcggtcttgagtaactatggctatttttaaattgcatttgcttacttcttcctccagaaaaagatgaccatagaaaactgcccatttccacccagattaaattgggtctttcaatactttccttaaattaatataaattgtgtaattttcagctcatacgtggtgagccatatttctgggcttttaaattttcacagtgctgatggaaactcaagatattttctttgtaggagccttaaatatttgtgagtggaataaaactgaccaaatatatcaaaatatcttttgaagtagaatttataccaaaatggaatatattctctgctaggatggtatttgaatgtttattttctttctttctttttttattaatgaatctctaaggttaaaaaggaaaaaaaaatcctttttcaggtcaacaaagaaaatgctcttattaaattttgtcccctagaattaagttttttggttgttgaaactgagtgagcagtttcagtcttctaaaaataatcagatttcaagctaatctagcctttttcttttaactatataattatggttaatttaaaaagccttaaaagtgtaaaagacatttttaaatatagaacttttacatgtcatttagataagaggataaagctatgcaaagagcaattttgaatactaatgtcattaaataatgacttatttcacacaaattttatttgacaaatattaccaaatcttgtcaatacctttttctctgatgaaagaaaagattatattgacatatgtacaaacatatgtaaatttttagcagatgattttcagaggtgactttcgagaatgtgtctttggctccttggcagcactgttttgtggataacagaattttttggttttttttttttttagtgccgtaaagcaggacttgctctctctaaacactataaggtttacaagcgtcctaattgtggtcagtgccactgcagaataactgtgtgccgctttggggacaataacagaatgacatatttctgtcctcactgtcaaaaagaaaatcctcaacatgttgacatatggtaagatattgaatttaaagggataccatttgccctaaccatctaactaaaaggctaataatctgagaatataactgaataactgtcaggctattcagaagagaacgtgactcaaaagtattttagtccttgaaaggaaatagtaaataatgtcaccaaagaacctgagggagccaaagatgatttatggaccagttctgaatttaggtggaaaatctctggctcagggaataatatctagcctttacctttaacctagtttgtaaagtgagtaccaggagatgtcaataattggaaaaaaatgcaactaccttcaaaagtctctgcttcacttagaaataatattataaaacaaaagcaagatctttttacagattgtatgtctagttggtgaaataatagaccacttactaaacccacgtgtagtagttctgccagttgctgagtatgtctcttccaatgatacattccagaactggagaaataaccgcaggataggtttgaggacttactgtgagaagtatttgggctaaaactccattgatcacctgaccagactggtggtggatcacagtgatatttttgtctcctggaattagtgtcagttcagagccagtgtccaataatccttgaaaagtctgattattttcttttccccaatgtacagttaccttggtaacaggccataggaccttttgggggaaatctaagagaaagattatgcagtagaaagcagctgcatagcagtatatgtgattataagattatgtagtataaagcagctgcatagcagtatatgtgattataagattatgtagtataaagcagctgcatagcagtatatgtgattataagccagtagtaccagtatgacatgaagcacaaaaaatgctgcatgggttcagggatattagaggtttctatgtgcaggaaggttgggaagatctcaaagaaagcgtcatttgagtggagctccttgttccactctttccccccttctccctactgtacttgactagacttaaaaaaagtatcatttgaaatttaccttaaaaaatagaattttgattaaacgataaagcaaacagtatttaattggaaaaaaggagcatggccacaaaccttgactcattaataaacatggcatggtggagggatgatgagaatactggccaaccccaacagaggctccacgttgtggaataataaaagctagttttacagggagagtgggatcaaatggtgggggtcattagtagtttggagaatggttaaggtctttcctaaattagcacattaaggacttttagttgattgtagcatagttaacatggaaaacgaagagactgaaaatgcatgtaaagaagctggtgcagagtaatgggcaagcgatggttaccagcctggggtcaagacactggacgtggtaccctagtaaaactttttaaaagtcaacaaggactgtggcagatttgataggtaggatgatgcaaaaggtttcaggaccaaataataaaaattttcacattgtgggtctgggaaaattgggatgcagcagtgaagatgcagtatgtgttagatatgtgaaagaaccctggaatatccaggaagacatgtcttaggggctgcgatccaggatgagagaggctgtcggcacagtgctgttgattgaagcattccaacttctcagttcagtaagaatgagaaaggaaatgagccaaggtctgagcttcagcaaatacctataactacaaagtgggcaggaaagaaaaagcaaaggaaacaaaaccataggattggacataggaagagactcagggcaccactcggctgtgggaaacccgggaggtgggaagtgcggtcatgtctgtagagctgggggcaggggagggagctggtgtgcagaggaagtcccagcttaagtcttcataaatatgtccagaactgcgtgctttttctttgtgtccctgcgtttcattttctgcatcactcttcttgttctccaatacttttctctacagcactctatatcttcttccactcagccgcttcaccccgtgttactatcatagacatctgaaatacatttagataattttatatatatatatataatacacacttaatggtttttaaattttttatgaacattcataatttttttttatgaacaagaactttcatagttttttatgaacaggaacttttttataatataggtatacatttatttgaccaagtaactagatactgcgttgaacacagtagctggcagatagaagatcttcaatatatatttgtctactaaataaatgattaatgttctgtattggttttctatgaattgatatctttgagattaaaaaattataaatatgttatttatcacataaatagttgtcaatgtcaaaggtttttttgaaactagatttcaaagaccccacagttccccaaaagagacctatgagttagggaaggctgtgctgaaaatgttctgggccttgtaatccctcttccctcccgacctgattctgttttctacactggcagtcagcttaagactttgtttggaaaatcaactatacactgtgaaataaatgtttacatattttaaaaagcttgaaaaccaagatgatttgccctgttcttagatttttctgtgaataagtacatcccatttattttctggatgagtatttgatccttttttatgttgattaaattttctcattttaatgtaaagtcatttcaagttaagctgaagaagtctgaaaaggccactaccaattatctaaatcctcctgtttcttctgtctctgaaagcttactgaactcatgaagtcctcccccaattttccagtttctactgatcatatcacacttttaatactgatgctatttattgttggttcttttttctttttatttgagttggagtctcggagtctcactctgatcacccaggctggagtacagtggtgtgatctcggctcactgcaactttcgcctcccgggttcaagtgattctcctacttcagcctcccgagtagctgggattacaggtacccaccaccacgcccagctaatttttgtatttttagtagagacggggtttcaccatgtgggccaggctggtctcaaactcctgagctcaagtgatctgcctgccttggcctcccaaagtgctgggattacaggtgtgagccaccgtgtccggcttattgttggttcttaattatttgctagctaatataatttatgtatgtgagtattatttcctttaaagaaaacagaggaggtagtctttacctttcattagggactttaaatttttttcgttgttatttactttatttattagggtctgctatacaccaggtacttggaatacaaagacaaaatagaacacagcctctcaaagtgctcaagggctaatgtgggaagtaaatggtaaatagataaagcaccgtgatggaagtgttgtaaagggacatgtttatcctactggcaatggaagtatggaagaagaaacacttaagtctacctgggaaggacaaggaagtctttctgaaagaggcagtctttgagcttagtatagaaagaaataggaattcatcaaagacaagaggtaggaaaaggattttctgaaagacgaaacaacacatgggaaagtatacagggagaacatttggaatgctgcacacaggatattttgttccttcaggagcacatattcaggtctctaaaaaccatctagtttggaaatgtggctgtagttggttgccagtcaatgagaatttagtgctgtctgcaaaccaactcttttttttttttattattattatactttaagttttagggtacatgtgcacaatgtgcaggtttgttacatatgtatacatgagatgttacatatgtgtacgtagagatggcgtttcccatgttggccaggatggtctcgatctcttggcctcgtgatccacccgcctcggcctcccaaagtgctgggattacaggcatgagccaccacgcctggctttttttttttttttttttttttttcttgagacagagtctcaatctatcacccaggccggagtgcagtggcacgatctcagctcactacaacttccacttcctaggttcaaatgattctcctacctcggcctcccaggtagctggaatcacaggtgcatgctaccacacctggctaattttttgtattttcagtagagatggggtttcactatgttggccaggctggtctggaactccttacctcaggtgatccatccacctcgacctcccaaagtgacaggattacaggcatgaaccaccacaccagccaagttttttcttaaatagatctcctcccactggaatatagttatctacaaatattcaataaatataggcttaatgaacaaattttgcccctacatatctattacaactgctctcttgaaaatcacctatttcccagaggtcttaaataggcttcttcaagcctcaccctctctaattcagttgaattatttttaaatttttaaaattttaatctttttaaagacaggagtgcagtggagtgattatagctcactgtgatctcgaactcctgggctcaggtgaccctcctgcctcagcctcccaagtagctgggacaacaggcatgcaccatcatgcttgcctaattttttatttttatttttagagatggaatcttgttatgttgcccaggctggttttgaactcctggcctccagcaatcctcctgcctcagctgtccagagtgttggaactacaggcataagccaccgtgccagccgactcagttgaatttaattctctccatcacttcccatctttgttcctatagctctgtttcttctgcctctctttcatgggctccttttcttttgatcatcaaagttaaggcaacagcaaggctctctattggacctttctgcctctcctccctccgtgcattcccagtgatggcgaatactaccagattcagctatcatctcagaccatttctggtaaagatctttaggttatgtgtcaaactatagttcttgggccaggtatggtggctcacatctgtaatcccagtactttaaaaggctgagagggaggttcacgaggtcaagagattgagaccagcctggccaatgtgggaaaccccatctctacgaaaaatacaaaaattagctgggtgtggtggcgtgcacctgtagtagtcccagctacttgggagactgaggcaggataattgcttcaacgcgggaggtggaggttgcagtgagccgagatcgcgccaatgcacttcaccctaggtaacagagcgagactccgtctcaaaaaaaaaaaaaaagaaaaagaaaaaacctatctatacatacatgtataagacatgaggcgatgataagtggtgattagtgttctcaagaacatgagccacagtagcggatagtgacggagacggctcatttttgatagggtagcagataagtccgtggggaggactttgttgaaaagatttgatgacttgtagcaatctgagggtgggggaaatatttcaaagaaggtagcccagaaaagcataaagcctctgagttgttgaaggaagagaaagaaggcatgtatgactgaaccaagcagagggaatgagagacagaggcagcccctctgcttgggagggaccaaggagcatgcagagtcggcttggccaaggcaagtttctgagtagactggggagcctttggagggttttgaacgggcgtgaaataactgacttaatgtttgaaaagattaatcactctggcgactgttgccaatacttttgagctgggaagccactgggagagtttgagcaggagggcagcatgaagtgacttgggttttctgaggatgatttgggctgctgtgtggaatagagacggtcatggaaccagagtgaagcggcagcatcgggggctctcaacagtagtgcaggtggtaaatgctggtgacggggaagagagagaaggtggtgggaaaaaaaggttgaatttaggataattttggaagttgagttagggttaaggccagaaatttatataatttgggggcccttatttatgaaaaacaataaaaaattatgactacaacgttaggtcctaatgtgaatatgtagaataagaaatcacaacaaattatattttttaaacaccacaaacatcagaaaaatgagatattattagttcactgcctgacacagctgtgtaattgtgttcctttatgtttttggctgcaaactccttgattgccttttcatatgaccaccaacaatatcattacatcttttattacggctagatgagaaaacttttagcttcacaattggctgttgatagtgacacatctccaacttcctctatcttttctttaagcagtacttctctgtaaggaaaccctaagagcagtgcctctcaaactttagtgtgtaccagcattttctgaagggcttgtgaaaacacagattgccgggccccacccctagagctggggattcagtgggtctgaggaggggcctgagaatctgcatgtctaacacgttcccacatgacgcccatgctgctggcctgaggacttgactttgagaaccccagccctttgatcttcctcaggtgcctcaggttccccccctctaccaggttgtttctgagttagggtgggtagtataggggtagagtggcctggcagcctggatcatggtggcctgtgagctcggaacgatgcagtatcttttgttcaggtccttctcctcaagcctcagggcagagtccgcctgctccttgaggtcaccagggcaatagtttccctgggcactgaacagatgtgaggtgatgctggcagcacccaggcgccaggattaccgctgcctgcaatcctctgagtccccagcatgtggtcgagttatggctcccattctccatgctgcccaccccagtgtgcagaggacacgtcaagccatggaaagttaaacttcttttgcttcatgtaaatttgcatctgcagcagatcccacgggatttgctgatggactggaagtgggatgtgagaaaaggaagtgttaaggatgacttctaggtctgggcctgatgaattgagcgatactgatgccatttcctgacatgagatagaatagtagaattgcagattggtggctcatgaatttttttttttttttttttttttttttgacacggagtctcgctctgtcacccaggctggagtgcagtggcgtgatctgggctcacttcaagctccgcctcccgggttcacgccattctcctgcctcagcctcccgagtagctgggactacaggcacccgtcaccacacctggctaatttttttttttttttttttttgtatttttagtagagacggggtttcaccgtgttagccaggatggtctcgatctcctgaccttgtgatccacacgtctcggcctcccaaagtgctgggattacaggcgtgagccaccgcgcccggcctcgtgggtcatgaattttgtctgtattcatttccgctggctgccatcataaattatcatgaccttggtagcttaaagcaacagaaatgcattcactcaaacgctggatgctaaaagctcaacatcagtttcattgaaccaaaattaaggtgtgggtaggactgtgctccctctggaggaactggggggaatcatattcctttcctcttctcgcttccggtgctgccagcgttctttcatgtgtggctacatcactgcaacctctgcctttgtggtctccttgccttctctttggtgtgtatcaaatctccccctccctctctcttataaagacacttgtgattgggttaagggaccatcagctaatccaaaataatctctctacgccaagatccttaattacatctgcaaaccctccttctttataaagtaacatttatagattcctggaattgtgccctatgtctttgggaggccattattcatcctactacaaaacattaagtttgggattcttcttacacatccaagtggagattgggaagaatttattaatgagtgattaagaaatagagcagtaaagaaaggaaagaatgtttccaaagcctccatatgtaacaataaaattctccttatgatcagggaaacttttaggacagaagaaaatgaaaatagggaaaagttggagcacatggaaaatctaaaagtcatttaaattgtgtttgtttaattatagataaatgcatcatgctgcctttcaaagtaagttagtagaggacagagattaggtcaaataaacaaattctgtagaagatctgatattccatagggataataaatactgagtggcattaaaagtcaagggaagtaaagataaaagaatcctaatgagatgtatcttactttcagattttcttattctatttattattttaccagacactcctgaattttaaaactagtgtaattatatgtaaggaacaaaatgtcacaggagacaaggttacctttgaaagtcaaagaactcatgttctgaaatgtaagatacatagcctttacctgcaagagctttgttcagtattaatgtttgggatcatgaagggaatccgtgatactgccatggttgcttaactgtgtgacatgctctatatccagacctatagctagctgtgcattagagagtaggactatgtcacagccgtataaaggcattttgtgtaaaaatacatggtcaatgaaggacttcagatggagaatcatgatttatatttgtggccaaaaatcagggttttattgtttgcttgctaatctattaattggctatccaccatgaaacagtcttacatgaagggaaacaacacaaagagatatcttttttcatcattatgaattaatgaatttacatagtgctcagcagatactgtagagaaattctagagtttcctgagttttctgtgcacatgaagtaaatataaaactttcacatctttcaatcctctaatttctgcataggtgtattttcccataatttaattgaataaaggtattttcattttgtttgggaaaaaagtaccaattacttaaaacattatttgagaaatacttcctaatgtgatatcaaatatttttagttggtttaaaaaaaagctactcgattatttgactctaaataacttttatttgatgtttctcactttaacaacaattagttgttaaaggggggtccaggtgaaaacattttactctggccaggtgcagtggctcatgccttaatcccagcgctttgggaggctgaggcaggaagattacttgaggccaggagttcaagacagcctaggcaacacagcattccatctctactaaaaatttaaaaattagccaagcagaccaatgtgcacctgtagtcctagctactcaggagattcaggtgggaggattgtttgagtccaggagttcgaggctgcagtgaactataatggtgccactacgctgcaacctggatgacagagcaagaccccatctctacaaaaaaaaaaaaaaaaaaaaaaaaaaaaaaaagactctaagatacagtactaacttccaagcaataataaagagatagcattggggtattaatggttctataatcatttctaaaatatccagacaagaacaaggcaataataacaatgattaattttaaaaattatcttatagcaagctaccgactagaaatactataatcagttggacatctagcagggtggatcatgttatggactccgtggctcggaagtcggaagagcactggacctgtgtggtgtgtactttaatcaataagccctcttctaaggcatgtgatgcttgcttgacctcaaggcctattggtaagactgaattttgattttgagtttgttacatttctaagagggttaattatacaaagtcaggaatatatcttgctccatcttgatattccataactaaataaaatttctttctcaaaggtttaaaggaattgccagttttcacatgtaaaccatgctaatattctgttgagtattttttttgaacagggagggaaagcatgtttgtgctataacagtatgtgcctttgtatctcaaaaaaatggagatgatcacatctgttctctactgtttctaatgaattattcaataaagctttgttttatgcagatttcagcaactttcgagtttgttattcagtccaagtgttgcataaattgaaagggaggatttctgtaagaatctctttgcaggtggaatagaaaaatgctgaattttttctcttctttatcccttctaccccgtgctattaaaatctgtatccagacaattgtactgatttcattgaaacccttcaaaataactctttatagctcacgatttcatgcatttagggcatgtaaaacctcagaggaaacctgtgattaagagccatctcattgcagcggcttctattgtgttctcaaagtgttatttctttcttcaattagagatgagaaagttcattcctgacttacgcacccctgcattgtgtcaactgtcatattgtgttttgtttcctgggccagaaaggcagacatcaccccttgcacagctttgctgtgctgcatctcctgtttccatccctccctcttcagtgtccttcagcagaggcggagcccatggaaaaacacaatcttaggttgccacattgatttcaacattctgaaatgcatttatatgtctcattaactattttcttgttaatgtttctgagtcagaaagacatcttaatgataatatagaatgtattatagtacagattccaaaatcctaggatactctgttgtgaaacattgtatttaatagatgttaagtctggccagtcgcggtggctcacacttgtaatcccagcactgtgggaggctgaggcaggtggatcatgaggtcaggagatcgagaccatcctggctaacatggtgaaaccccatctctactaaaaatacaaaaaattagccaggcgtgctggcgggtgcccgtaatcccagctactcgggagtttgaggcaggagaatggcgtgaacccgggaggcggaggttgcagtgagccgagatcgcgccactgcactccagcctgggcaacagaacaagactccgtttcaaaaaaaaaaaaagaagatgttaagtctttgtaattcatctttacttattttaaataagcctttcactttgtcttgtcattcctagtagtctagaaacaggtctctaactgctgacctaaagctttatgggatatcatctctcaactaccactttttaatgctttgcctaatattagcaaaactgataactgagtgacctttaaatgcttaaacatcataaaaagcaaatataaatctttgttaaacccatgtctgggtttctgtaagtcgaaattttgcattttacataatatttcatttcctagccagaagatgattaattctgacttgtctgagctaactttgtgttattagttctatatattagttcactgtaataaagtgaagtaaattttttaatcaaataaaaagatgtttcacataatcagtatgttatatttatgggactattgcagaattacttctctctccttccagattcagtgctcaagagtgaagaaaattctactgtctttagccacttaatgaagtacccgtgtaatacttttggaaaacctcatacagaagtcaagatcaacagaaaaactgcatttggaactacaactcttgtcttgactgattttagcaataaatccagtactttggaaagaaaaacaaagcaaaaccagatactagatgaggagtttcaaaactctcctcctgctagtgtttgtttgaatgatatacagcacccctccaagaagacaacaaacgatataactcaaccatccagcaaagtaaacatatcacctacaatcagttcagaatctaaattatttagtccagcacataaaaaaccgaaaacagcccaatactcatcaccagagcttaaaagctgcaaccctggatattctaacaggtatgatgcttttaaccttggtctttaagataattgcttttttttttttttttttaagacgaggtctcactctgtcacctaggctacagtgcagtggtgtgatctcagctcactgcaacctctgcctcccgcgttcaagcgattctcctgcctcagcctcccaagtagctgagattacaggcacatgccatcaggcccgactaatttttgtattttcagtagagacggggtttcaccatgttggccaggctggtctcaatctcctgatctcaagttatctgcccacctccgcctctcaaggtgctgggatttacaggcttgagccaccatgcccggctggttgcattaagttttaagaagacagaaattgtcccttggtaaggaagttgaattacttttggtaacatgaatcaaaccctaaaagactattatagtagtctgtctcccttcccttctctagattataatgttagagaagggaaggaaatgaaaaacgtaatttcctacatgtatgaaaagttgggttttttttttttctgacaataaccatacacatgatcaatacagaatatttggaaaatattgtaaagtataaagaaaaatatttgtcacccataatcatactgcttatcaataaccagttagcattttttaatatttccttccaatgaaagatagtcttccaaaaggggaactattttttataaaagtttagtaagtatactgtgttctaaaaggaggggtctgaggtgcctgtagtgacctttctgttaaagaacgtggatggatctcaaacagtcatgcgagatggtgtttatttttatttttatttttttctttgaggtggcgttttgctcttgtcgcccagctggagtgcaatggcacaatcttgcctcactgcaacaacattcggctaattttttttgtatttttagtagagatggggtttcgccatgttggccaggctggtctcgaactcctgacctcaggtgatctgcccacctcagccttccaaagtgctgggattacaggcgtgagccactacgcctggcgttgttctttaactaaaagtcctaaaaagcatacttgctactttgtatctgaaattcaaaagttgtaattctaactaagaaatactaccagagcagatatattttataggacttccagctacatgtccaggagaacaccctcatttttgtcacctgtgatacagaaattttaatacataacgtcatcctctcttttccttaatgattatcggcagctcctgaaacaattttctgttgaccctccttccccctttatctggccctcccagtccctttatctggaattcctaactatggcaacccgatgttatatctccaacacaggacacatttctccaccattttcttttctcagctgctttcttttttccttcagaaagcagctgacttacatccagcatttttaaataagtggagaatttataacatataaatggagggtcgtcctcccatgtatgtcttttcttgccaatgggagacaggcagagaaggagttacagtcatccctcggtatcctcaagggatttgttccaggacccccaggataccaaaatctgcagatgctcaagtccctgatatgaaatggcatagtccttgcatataacctatgcacaccttttcatatatttaactcatctctgcattacttcttataatactgaattcaatataaaggctgtgtaaataattgttatactgtatattttgtgtaatttttttattgtttcattattttttgtttccaaatattttcgatccaaggttggttgaattcatggattgggaacctacggctatggagggatgtactttggttgggacctagagtaatctcaggtggaattctgagattcactggcttttcctcttattagctgtgcctttactgatgggtagatgccttctctcagcggtggggtgagggaccatttggtgtaaactcctagagcaacctgtaggaatccttaagcttatttcataacaaattctgagacagtctctgctcaatagatgtgtttactccaagtttcctattccagctctaaatttaccatcagttaatcctgatgatttatccttgactggtttttttaatgtcttgttcataatcatttatgataactggtttaacttttgttcatatactcacatttgaagtaagctaagggggctaaacttttaactgactggataaatccaccacgttttcactttaaccctaattagtgcctcatgatagaagttcattaaggagttaattaagaatgtttgagttgggaggctgtcctggaacagaaaatcatttccaaacagtcttttctgttccgtggcttaagtggaaagtagaagtgatcatcttaaaatattgtggcatttgttgtacctagatgaaatatcttggcatatttttatttccttaatgctttgtagaaaatctcagacattttaactaatgaattagggatttaaaaaaacattaatgtaaccttaaatttaaatgatttcttcataagccattagtaataggatcatatgattaatcacagtgcacagcattacttaggaatgctgcagcctgtgtatgtattgaatataagaacaccaggactgagactccacaatcaatcaagatcaactagcagaataaatgtcaagtgatgaaataaattcacccagcagcccttctgcacccagctactttacaaggaataaattgcaaattactgtcatttatttcatttttctccttgtctggcagctatagtgttcatcttgtggacaagatgcctagcagaagctcacaacataatactattaaagcaggtggtccattcataatttatagccagtttattttttctttaatattatatgataattactttgacttttgttctcttaattactgttctcattaccacacaatccatgcagtgttgatgaggcatattttctgattggtcttgagatagatgtgtattccatccagctattggcttataaattagatgattgaacccatttttaaacagttaagaataattactagaaacagtttaagttgtcgatccaattactgtaaacacagagcaaaacacagtgatgcagtttcaaagaatgcatgtgttttaggctgaaatttttcctgcgttgatgcaaaggctcacataggagggtgaaatgacaataacaaaatcattaatattttctcacatttgctgccgtcagggatgttgaagatctgtctttaatcaccagtgcaagtactgacaccatgtccttgtctcttggttgcttcttggagttttcagtctcaggatttcagaaccacctggggccgtccagaatgagtcatttcacttttgtttgttttaatcctcgaaataatcctgtatgacaaaatctacattcagtgagaccgattaatccaaaaaattcagacagtatttttattataatgaatcgccctatctataaaatgagttaaaccaagcttgtccaaccataggcttgtgggctggacggctttgaatgcagcccaacacaaatttgtgaactttcttaaaacgtgagttttttgtgtgattttttttttaagttcatcagctgtcaccagggttactgtattttatgtgtggcccaagacaattcttcttcttccactgtggcccagggaagccaagattggacacccctaagttaaactgtgataaattgaccatgaaaaaataatattcactttaaaattacagatctgtgcttagtaatgtcttccttcttgatgatagtttttgtctggtctctgttcagttttatttattaataagtattgagaatctattatgcctcgggcattgttcttgattctaatgacatgtacatgagcagactatagccagcagggccaaatccatcccaccacctgtttgtgtaaagctttatttacatttgtttagatattatctatggctgctttttgtgataacaaacttagaccgtaagaccagcaagcctaaaatacgttatctgaaaaggtttgccagccccgatctgttgtattaatagatcacttataacccagaattaatattcaaaatcatggtcatgatcacgaaaatgaacaattctgtatgctacatttaagtaagaaatctgctatattttagaaagtttttataaaacaaagaggaactaagatgtcctcagttaatcagaacatttaattatcctggataatgttgtctatcataaaattaagattagctgtgcatatttagagccagtgtgatacaggtggcattagtatcttggttacgttacttcagtgcttcataacttaatgtgcatatgaatcacctgggaatcctgctaacatgcagattctgattctgcaggcaatcaggagtaggggtggatatgtctgtgttttctaacaagctccgggtgatgctgctgcttctggtcagtggaccacactctgagtaccaagaataagatcacacgtggctatgtttttgttgttgttttttgttttttgttttttttgagaaggagtcttgttctgttgccaggctggagtgcaatggcgcgatctcagctcactgcaacatctgcctcccgggttcaagggattcttctgactcagcctcccgagtacctgggattagaggcacccgccaccacgcccagctaattttctatttttagtcgagacggggtttcaccatgttggccaggctggtcttgaactctcgacctcaggtgatccgcccggctcagcctcccaaagtgctgggattacaggcgtgagccaccatgcccagcctgtggctatgtttttaatttaatttttaagggaagaaatggagtggaaggcagaagtgaaggcagagagatgacatttgggcctctcctttctactttaatcctaccttctaccttggcccttctccccagaaaaattttaatacagaatctaaacctctccctggatatgtggaaccctggagctctctaggttgaaacaagtaggttagaaaatgttcaaccgttatccaaaacagccgcctctaaaataatatataaaactgtttttgtgtccacacaatttttaataagaatgcatcatttcattaattttgttaatattcttaatcttttctcctttaattttaagagagcattgtttatgaaccacttgctttaattgtgaaatctcttgacttctctacaactgtccagatatctggcttcccttgaagttaaagttttggaggagattggtgaaatggagttttggagggggttggtgaactgaaaggttgtggaaaagaaaagtcctctgcctctcagctttcctatttctgatctggtattacccatgacttgaaaatacagccaccacccctctaccctggaaaagttaccatcaaaatagttgctggtgaagtatttaatggtgacgattgatttagcaatgcctgcagctgctcttattttacaaatggctattgaagaaaccttcaaaaactgccctcagaatgtttgagttcatcccagcaaacattttcaaagcagtatatttaagcatcctttatataaatgaatttcagtccatttaatcacaaataagagattgcattctctgaacatttcaattagatatgatgcattgaggcatcatagaaacaagtgtgtaaaaaatgcagtttaggaagcaaggaaaaagggaaatcacctttgatttttaagtttttttttaacaattatttaagaatgatatttttgttctttagatatttaccgaaaagatgagaatggattaactgttttatcattaaagagttaaaaaaaaataggaatattaagagggggacttctggttttaatgaatgtgaacactttctcttcaaccagtttattaaaaaactaattctcttaaaggcattattaaaatatgcacaacacagaaaatttaaataagcttcttttcaagaagaaaattctgtttatacagctacagtacaaggccagcttctagcctgtgtacactgggtatgagggcaacctccaaatactcttgatcctaattatgggggagaataaagcttccctgctagctttacaaaattcacatttttgctctctgccaggcagcctgtttcttgcaggaatatgattgcgactattatagtagccttgatcaaagaaaagcatagaaaattgtctttaaagtggacagcagagagagtgatttctatggccttgtcagagccattgatgagagtttgctaccgatgagaaaataattagagaagattgtgactagctactttggggccagtgggaatggagaacctggacttgagaatattttagaggaaaaagaagtggctacagtgtgatattgggtaagaaaagaactgaatatcacaaatgaaaaataaaatttgatttactggatacacagtccagctgcttttgttctttagaaagttaaattacgtgttttaggtacataggtaactttggaaataaattagaattacctgggaaaacaaagaataaagacagccttttgcataatgacctaatgttaacgaggtccactttttgatagaatttcttggtacaagtgaaattctgacatgtgggggtaaagtggtgtgaatggtcccttagcactcctatgctgtacttattttgtaacctgtcattacagtgaacttcaaattaatatgacagatggccctcgtaccttaaatcctgacagccctcgctgcagtaaacacaaccgcctctgcattctccgagttgtggggaaggatggggaaaacaagggcaggcagttttatgcctgtcctctacctagagaagcacaatgtggattttttgaagtatgtgtaagatttatctagcttactaaaatgtaattaaatgctttggttattaatgtataacaaatagcaatactttcctagttttaccttttacctttaaatttgaaatagccatattggcattcagtctaaagcttgaatgttgactaacttaaaattcagatgttcagccacaagaaatttaataaaataatagctattacattgttagagtatatcatatttataatcataagtctagaagtgttgcacttagcttgtaaagttagaaagacactgagtgactagtaggtactagtagtacatatgtggctaataatccaaggtaagaatttgttcttcctaacttcagcgctacatcaaaacctttggtttatgcattggataaaggtttataagaaaagcaatttacatgcctgggatttacaataaccttatcaaatcctacttaaccacacttgacccaaaaaagtgatggcaccatagcaatttagctataggcgattcctcctgcctttccagtctgtggatgtatccctaaagatgaacctaagataggagataagaacctcaggtccgtttagtcagtctcacttccggtattcctcggtgtgagcatctcatcaggctgagtgtgattctaatgttcagagatacatattttttctagttactcttcatctggaatagaactgaaaaaagaaaatattgatatgtttcagtgctggcgcaaagattttctggtggactttttgaaagatcaaatatctgtcttcaatgtgataccttcttaaggaatttcccggggaaaactggatagtgattttagacctcaatctctaaacacagtgtaactctaccctacaaaattcacagatttcctcctcaagaagcttttatagatgtaatgggaaaatattattagcaatattcatggtattgctaaaaatataatagcctttttcatatctctcttgaggtcaaaattagtaagaataatataatagaatctgtctaattcagtctgcgtaagtatttgattctttcttttcctaaggaagtttaatattaaaatcatgacaaatctttgatcttacagggttttttttgttgttgtttgatttttttagagacagggtctccctatgttgcccaggctggtttcaaactcttgtgctcaagctatcctcccacctcagcctcccaaagtgccgggattaaaggcatgagccaccgcacctcacctgatcttacaggtttaactgaaacagacctatagcagggatattggtgattacagcaagattttgatagttttcaattattcttaacaaagtgaagaaacttctgtaaatatacctttagataaagggaagctcagaattatggccattttctgcgtgattcaaacaaatttgtaagagagatgcttcttttaggatataagcttttttaaaggcgacgactaattactggtctattttacaatgtcaaattaatgataacagcagtgaagactatatggcactaatcacatgtgcctagggttagcctgtacatcatgataacttttgtataaacttgtaaatttacctttttttcctgcagtgggcagatttgtccttcccattctgcaaccatggcaagcgttccaccatgaaaacagtattgaagattggacctaacaatggaaagaatttttttgtgtgtcctcttgggaaggaaaaacaatgcaattttttccagtgggcagaaaatgggccaggaataaaaattattcctggatgctaatatctgtagattctctggcatttagtctcttcaaactgtgtataatgtttggtcctcctctgtttcatagaaaagtcatagaatatctatgatacattgaaaagttactgcaatatttgagaactgttctttttttttcttgtgtgtgccatctttccattgttggctacgtcttttcttttgccttgatgaacgttctatgtatttcatcggatatacagcatattccatttaggatgtgtatttaatgcatttagtaatgacgataaagtgtttttagtatgcttttagtctcttgtaactggggagaagcagtgttttttttttaggaaaggattatgcgacacaataaaataagatattctgtctgtagtgaatacatttctcatgtactaacactatttataatatatgattaaagatatttcttgttttattaaataataagaaataagatctcctttatgaacaagtctatttttaaaattctgttcaaccaacattaagttcctgttagaggctggggctatgccaaaccttgtatgacttcaaatttgtgttctcatgtaaagtgatgtggatgcagactataaaagtaacatttaagaaaagaagaacttgcgtgtaggcgtttaaaagagaggttgatttatatttttctaacgccctctccccgctgcttgtatttaaattttagcacagatcactatgattgttcctcctcgataaaaagtcactcttaaggtgtttctgtatgcttgtaaaaaaaagtcctttcagagctggttgaatctgttttttttaaaggacagcacaaaggtggcttgaaccactttcccgttctaccactaatttttccatgcagagctatagaagttaacagcatatgaaattactggcaagaacaaaacatgttttatagttttataagtattttgttttgactctacactgaaaagacaggaccaacctaggatgagtgatcttcacccaaattgctcaacagggcagtgactctacagaacagaccaggaactggactggacagttgacaatcttagctgcactgatgtgaagtacatagagagtacattaggaaggaaactgcaagctaattgtgcaataaagaggaaaaaaggtccactgcaaaaaggacttccaggaagtctggtctccaaaaatgtgcatgttaattacacggaaatgtaagtaaatgaaactataggttatatgataaacttacatccttatcctaataagaaatgtacaggatctatatgaggaaacttttttttttgagacagggtctcactctgtcccccaggctgcagtgcagtagcatgatcttggctcactgcagcctcaacctgtcggactcaagcgatcccctagcctcagcctcccaagtagctgggaatacaggtgtgtgccagcacgccgggctaatttttgtattttttgtagagacagggtttgccataccgcccaggctggtttcttctgggctcaagagatcctcccactttggccttccaaagtgttgggattacaggcatgagccaccatgcccggcctgaagaaactttcatctgagagtcccagagaaccagatgtattctggttcaaacaagaacaaaaacaagttcctgtttggaaggaaagattgtttaaaagacagcgttctttcagacttaattctattatgataaaatttctcataaaaaatctcagtgggggtttctgcctccttgtgtcctggtgagctccagctgaacccaacctccccacagataactctagattccggacaaaatcaaaagcaccgctggagagtgaactaaagcaggcagattcttgagggctgtgaaatttagaagaaagaataggctggaggtgatttcccattttttacagcttttgtcctgagggcagaacaaaaacagaatcaagtaggccaaccaaaacttcagtagaaaacctgaagtatttctcatctacagaatcagcaggcaattttggcagccacagccactgggaagtaagggggaaatctcagaaaggacatggagaggggagccccacattctgtgaaactctgctgatgtcattgaccactgaaccatatatgcatgggacaaactgaacacggagcaacctaagataaaagagctgagctggccgggcacggtggctcacacctgtaatcccagcactgtgggaggccgaggcaggcagatcacgaagtcaagagttggagaccatcctggccaacatggtgaaaccctgtctctactaaaaatacaaaaattagctgggcgtggtggctcacacctgtagtcccagctactgtggaggctgaggcagtagaatcgcttgaacctggaaggtggaggttgcagtgagctgagatctcgccattgcactccagcctggtgacagagtgagactctgtctcaaaaaaaaaaaaaaatgctgagccaagatattatctgccatgcaagaaagagattttgcaatttgaatctaaccaaattaatctgctgctgagataaatacatcaacactctttagaagactacagcaggtccttgaataagacttcattcaacatcattttgttataactatgagaaaaaaatcactttcagccaaggccactatctgtgtggagttggcatgctctccacatgtctgcgtgagttttcctctggacactgggttcctaccacatccaaggatgtgtgctttaggtaaactggcacatgttcatggtcccagtgtgagcatgtgagtgtgagttgccctgtcatgtgagggcatcctggccagggagagttcccacctggtgccctgagctgccaggatgggttccaaccacctgcaacccagaactggaataagtgggttggaaaatgaatgaatgtgaattataggacaataaaaatttgccaagtatacaatacaataatcatacaaatgcacaacaacacaatatgaaacatttgcaaacatttattctgtgagttaactcatcaccactacaaccaccatcagtccctccaaaatttgggtgactaagaaaaagaaaaaaaatttactctgactgcagtgtggagggtgaatgaattcattcaccaaaatttgagtaactattttgtttttattaatctttcttaaatatatgtacagctcacgtttattttagtgtttaacattagaagtctgtttagaagtttgatgatgtttttgtgaccagaaatatgctgtaggaatttaactctggtttatatcaattagcctttgtgaaaattggttctgtcttagattattttgcttaaagtcacagtttccatgaacctatcgatgatgtgaagtgagaaattactgcatgccaaatccagagtcttcaccatataatacctatactattcaggatacagtccaaaactacacagcatatgaacaatcagaatgatgtgacccagttttagaggaaagacaaccaagacccaccctaagatggcccagatgttgaatagtaaacacagattttaaagcagctattataactatgttcattgaagtgaatgctagagggaaataaagccaggtggaaatccaaatattcaagaggcaatacagaaaatatgaaattgcaaatatctaaaggaatataaaatttttttccttttagtttctttaaaacatatgggacttttaaagcaggaaattagcttgtgaaatttacaatgcaggtagatatatgtgacaactatatcatcaaggatggagagattgaaggatctattatatgagttttctacattttatgtgaagtgttaccatattaattctaattgtacaaagttaatgatgtattttaattatctattaccaaatttgggaagtttgcaaccattatctcttccaatactttttattttgagatggagtctcgctcttgtcgcccaggctgtagtgcagtggcacaatctcggctcactgcaacctccgcttcctgggttcaaccgattctcttgcctcagcctcctgagtagctgggattacaagcacctgccaccacgcctggctaatttttgtacttttagtagagacaggctgtcgtcatgttggccaggctggtctcaaactcctgacctcaggtgatctgcctgcctcggcctcccaaagtgctgggattacaggcgtgagccaccgcgccaggcctccaatactttttcaatcccatactcttcctattcttctgagactccagtgatacaaacgttagattattagattgttattgagatccccaaggaacatagcccagatccctgagactctcttccttttttccagtctatttttctctctcttttggaccaattgagtaaattgtattgatctgtcttcaaggtcactgaatcttttccgtcatctccactctactattgagatcattcagtgaggttttatttcagttattatattttccatttctattacttccacttggttttttaaaaatataatttctggggtttttttgctaagatgttctagttttttcccctttggttttgggagcatgtataattgatttcttgaagcatttttgtgacatctgctttaaaattgagataatccccaaatctgacgaatctcagtattgccctcagttgagcatctagtctcattcagatggctgttttcctggttttcagcttgacaggtgatttttttctcatcatacctcggatgtttcagttatgttaggagagcttagatcctattttaatcttctatcttagcatgccatcagcctcttgaggtttagtgtgtaggttctggcctgcactgtaggctttggtttcaatgacagtgtcatttacagagcccttgcgatgcagttctgttctttcttctgatgctgctgtggctccttatcaatccccactggtgcagtctgtgggcacaggtgatcccctgggttgcctgctgtttctggagttggggagagcagatgtctctgtgcctgtgtttccttataccactaggtggagggaagcggttgctattgtcccacatcaaccacattgactcccacagcagcagaacctggacagagctgtcagatttcagagcctgcatctgttagtccttatgcttaacttgcgagatgctatgtggtctgctggtattcatctctttggagtttatctgcccatttcctggtatttcaaaccagcatcacaagaatataaaatattttaatgatgggagaaaaaactgagagtcagatagactgtggggaagacagtgatttcgagagccactgtttattgaacctttctttgcaacagccgctgtgctgaatacttgccacagatcacttcacttaattctcttgaccactctgtgtaatagactttgttgctgttgttgtggtgttgtcgctatttctgatttttcagttaaggagacttggacttctgtaggttaagtaggaagtgtgtctgtgtcacacaagccatggtttgaatgaactttgtgaagcactgatgcccacaccctgaataagctattctccttctcatttattaaggaaaagtagctgtacccagaattgcatgtctttaatatgtacaaatatctaagagtcatctatgtaggaaaaataaagggaaaaaatacacaaatgaaaataattgtggtatgatgagattatggtcatttttcttttctaacatttatgttaaatttacaatgttaaaattcccataagttcattttaaattctcattatacattttagttccattattttatttttaaaaatccaccgttttcatgtacttttctaaaggtacttatcattgtatattatagttcatcagtattggcaaattgggcaaggaaacgaaaaagcaagtgttctcatggggttcctaaaagatgaaacttctttttgtggatgtctttacagcactgatatcttttctggagtatactatggtccgcatcatgttgtatttgtcctttctgcatttcttaatgttcacttgcttaagaaattatatatgactcttccttattcttcacagaatcttaccaagtattgtactttgcatacagtagaaatttggtaaatatttgttaaactttgtagatggaggtttaatataatgtcagtctattgaacatttttaacgttgttaccactattcaaacatgaaggcagtgaaatgtcattgaaaagtgttactggaaaattcctgtatctaaaagctgttaaatctttccagtagtttaaatgaaagtccctttttttggtattttctagaactttgcttacagatatacaggccaaaattaatcgaatcaaaggacatgcattcagtaaaagggaaagaagacacagaaataatgctgccttacatctacactgtatttagggacatatagagatgagtaaatataattatatcttacaatgcccatgactttgtacctcttcgtcttttagaaaacaaagccaactgatttaaataaatgtttaattcaattaatctctgttgaacacctactatgtgaaagattcagggacaggtatttttaaagcgatcttgcagatacataaatgaggaagaaatgataagggaaaataagcactttaagcaaagtgctaaaggttgcagagagggaaatttcacatatgagtcaggagctaggagagcttcaggaaagaggtaggaaagagttgacatgtcaccttgatgaggatttgcatacgtagaagggcattttaggcagcaggcatagcatatacaaagatctctaagagcagcagcactagaaggtgtcagcaacagaaatattcctgtttggctagatcatagggtatgtgaaggaaaatggggagataaatgcgtaaaagaagaatcaattcccatttcatggctataaatggatcctgggatgggccagttctgagttctgagaatacaaaaataaataaatcactctctccttaaggagcccatgggcagataagcaagccaatgcacactgagatacatgctaaactgatgacgcagaggaacccaaacaaatgaaaaaaatgatcaatcctgccagtggtgtgggagatggtatgcatggtggttagtcactcagattctgaataaaattgagtcctggagtcagactgccggtcccaagatctgcaccagccctgactgtgaccttgaccatacgacctcgatctcaatgtttgaagttttggctagtgtgtgctaggtcttagatgcctcatctgttagatggtgacaataacagtacagttcttaacagggctcttgtgaggataaaataaaatatccacgtgaagggtttagcattggcagttaaagctcttgagttaattttattatctttatcagtaatagccctgctactgttatgtgtcacaactattctcctggaatgtttcagagaggaaataacaatggcgataaccttaaagaaggacctgaactacaccctacagcaaggggattaaggatggaaggaacagtgcaaaagctgtttttgtttagggaacagagtccagaagttcaaaataaaagtatttggaagagatgctggggtgagtattatggttccaatgagacatcaaaaatttagaaataggaaacatgaaagaactcataaaagtccttcatacatgacgaattttgagagccaaagcctcagattaacctaggcatatattatcctatagatagaaatcaggtatcagaacaatgaatgttattaccaaaactaatctctttctctctctacttctttgcagcagagattgtggcttcaagtgcatggaaacactgactatatagtgtttctggaggagcagattgtagggtcacatggtttcaccccatgatggatccaagtagttccagagtcacattcattgaaatctattcgagaaggggtaaatcctgtactcaaaggagggcctggggaacagcagagaatggaagaaacctattgttctactttctatgtattatttgaattgtattgacttctctaataaaagagtaatgagggaggaaaaaagaagttaaaaagagatgaagagctgggtgcagtggctcatgcctgtaatcccagcatgctgggaggccgaagcaggcagatcacttgaggtcaggagtttgagatcagcctggccaacacggtaaaaccccatctctactaaaaatacaaaaactagtctggtgtggtggcgagcacctgtagtcccagctatgtgggaggctgaggtgggaggatcacttgagccagggaggtcgaggctgcagtgagccatgatcataccactgccctccagcctgggcaacagagcgagaccctgtctcaaaagaaaaaataagtgatgaagaaaaaagtgaagacaaaaaaaaaagatcctctgactgcgaatagaaagggaaggatgaagagaacacctaaagtatctatatttatgtgggcacttggcatctgtttttggtaatcagtaacacaaatatatgtaatcaacaaaagaacagtcttataaatttttaaaactacatactagcattttgtactaaatgctatcataaaatgcaaaactgcaaaacaaattcaaagtctcattacaacaattccatatctaccttccatattaacatatctatgtcactcccaatcgctagcatgagcatcttggtttacctattaataaatacttgcctgcttgtaatatgcatttatttttctcattattatgttattacattcagcttgtttggcaccattttaaagaatttattttgctatcaataccagaaaacaatttaggaaactgaatagagcaggaaaaatgttaaatctatgtacttgagttggttattgactccttagtttaataactcattttttcaaacctgaataatttaaatgcattagaaatgatacagcattaaaaagtgccttctgaaaatggtaaacactggatctaggatctgagtttgtagttattacttatttaaaataaacaagcaaattccgttgagatacggtctcattttcaggaatggtctattagcaggcagcagtgagcacaacaattagccatatcagcacattaaagcctaatgtgtaaactcaacatagcagcaaacacacgtcctaccatggcctattaagtaatcagaaatgattgcagataattagcccaggaacagctgcataaactcaactattccattttttgtcagacgtggagacttcaagtggaagggaggtttatcaggtatgtcttgaattgggtgggagtaccactgtgaaatgagagacagattctaacatttgacggcatattgccattttacatcgtcttctgatcatactcctaacgttcacataaatattgttcttgggtaaaaattatggaaacaaagatatcaccagtgatttaagaaacttgtaaaattggaagtcaatatacgataaaaagtagaagtcggttagtaaatccctttaatgagcgtgtatcattcatacttgtttgtattttcagttcaaatttgatttttgcattcccatctattctttctgagtgacattaaatacagcaccactggtaaatatatatttgcatttgaattaatacgtatatttggtaagtatttcttttctaaatttaaaaaaatgtagtctccttttttttctattccttttttacaaaagaaaacatgctaggtagaagatgacaactatctgtagatctgaaagactgagataaaaagaaagaattatatttattccatgcacgtccagaaaaacagaactaagatacatgagtttgattgttaaaaagaagaataaaattccaaaaattagaattttaaaaaatgaaatgaggacgctgtgaggtgcttagctcctaccgggaatgtcatcagagaaattcagcgactgacctcctgcaggagtagatgtggttaaaaggaacctcaggttccatcaaagtttccttcccactgtaatattctaggaactataactaaagaggttgaagtccttcaaacacagctttgctatacacttgtccagagaccagcagcagatgggaatgccacctcttaaagaagactggaatctatgtttatctgtgcccattatatccttaagtttggacatttagctgaccttctcttttaacatgggtctaatttatttgctgtgtcattttccatacaattcagttgctttaaaagttcatttctcataccatgaattaaaataaaaatttgaccaattaaaaaaaccaaagaaaatggctcagaataaatgaatatattatcaatggtgctaaacttttgcagggtaattcctgaatacttgcattaaagattttgtatcatgaaattacacttagcacatgtttattgttttttgacagttttcagtttatttataggcctaccaaggataaaatggatagataaaattagaaaccataaatttcacagagaattagttctactgtatatattttacatttgttttctctctagttatcctcttttttataagcgttcaatcaacaaatgttgaagtgcatgatgtcagcaaggcactgtgaaagcataaataaagaacagtgcttcaaggagtttacagtctttggggggaattaagcatgcaaagtaactattacagcccaatgtgacaaggactatagtcgagagaggtaggatgcaaagagaaaacaggaaaaagaactcccatttcaacctggaggacacaaggaatcttcacaaaggaggtagcactgaagagatgagtagttgccaccttcaagcaagtagagtttaggagaagcctataaacagagaatttgtaaaggactacttgacatggaaaggaactagcatattgtaaatatgaatgataactggagctaaaatcaacccactctaataatggtcattattttcatgccgttcattcattgcaaattattacctgttctcacccaacttaccaagagtgggcttactataaccgctgtttcctagagcaacacttgttaagtaaaagtgctaataaaatgtgaactagcagcatcagcaccagcttagagctgcttagactgtccgggattaaggcccaggaatgtttgctgtccaacaagctctcctggtaatccttgtgcattctcaaatttgaggacccctgtcctctggaggaaaaagtatttgcttgtgttttagataacattttaatatactacattggaacacacatgtgagacttcttttttgaaatgtgttgtaatacgtgggttaattcatttaaaatggaattgaaatgtgaggttgaaaaaagaacagtgagtgcagtgggagtcaggcaacctgatttctcatttcagctctgccactaaataatcattaataataataataacaatacatatgattgctaacaaatatatgaaactctgccaagatacagaacttctcttggatctcagagtcttcagccataagacgagaaggttgtattagaagatctctaaaatccctttccaaatctaaaatacatttctcaaaaagtttccgcattcaccatttgcataattaaatagtataatcatccccaatcccttcagattagctccagttgttttcagcttcttgtgtcttttcaaagcagtactgaaaagaccgctctctgctgtgtttccctgtccatcactcttaaatctgcttttctttctgccctctctttcttttaggtcagtggttagttcactatacaattgtttaaaatgaggtattcttacttttatacatgtaaattcccatgaaaactgcttgattaaaactcccccatagacttctagaagaaaacaaaacaaattgtactaatctcagagtgtgaagcatcctgtcttgaaggtcaattgaacaattcacaggggctgaaaactaacaagaaaaaaaagtttcactgaagttaagatagaggagagaagatcagagaagctagcaacccaggggaaaaatgtcacactgctgttcgtgcacaaggccgctgaatttccttttctcttcctttctgtttttccctccctcctttcctttcttcccctacttcctttcttccttcttttttatctcttttgttgatgctgattgtctatctgttgaattgctttcacaccaaatcttgcttatgtaaactataatcttcaaaaaggcaagatttaataacccccataatatttagtgaatacctcccaaacaaataatttctcaataaaagcttaagggaaacacacttaaagaacaaatgcataatgcattataatcctggcaacagtcaattaattggctttctttacaacctatgagtgcttcttcccaaaacattttatttgtattttcgcaaggaggtacattttttctttcatctgtccactgcttcctcggctcctgctcgctttctgttaggatgtgtgactggggtcggacatatgctggcgctttgcttgtatctcacacactgcagtgttttagcacttcatattttatgtcctggctctccaactcctaacgcattcctgggtaatgcagcttctgcctgagtgcccttgaggcccacttagagcatgtgcatggttgatctaaaacttttcaataacccttctctgcctcagataggaaattacaagagaatgccctatttcagcatcacattgcaatcattctacctccatgccttatggtcttgcatcctcaaattggtcttatctgctatagctgattgtccagtgctttccaatggggctgtaactacagcatgtttccagcaccctcattttgtttcaggaatgaacatagataattttgatccatggtcaactccagtggtgaaaatcttcaaagctgttagttatcagttcaaaaaagatcggaagtagttcatttctaaatagtacatcatttctggaatgtggattactatgtaagcctctcttgatgccactcttaaagaaacatgagcaatagtctttcaaaacgctctgtatgcaaataattgctttgtcacagatcgtttttgagctacttattgtcacccactttattcacaatgttagcctaatgttactccctcagctaactatattgattccctcattctttcttttcccttcaataagatatgcataaatcaaacaaaagaatcctcagaaaagctttctctaaacctcaggtcagttcaggagcccctgtgatttttctcagttcaggtaaatcctgtatatgttcttcctagaaataatcacaattgtaatgaaatcatgtaaatcttgttgatgaatacctatctttcttttttaaatgaatgcactataagggcatggattttctcttcttcaacactgaatcccctgtgcctaggccagtggcttgagtgtaattggcattccataaatgattgttgagtgaatatgtatcctattcctttattaattttcctagctgctctttgcctgttattgtatttctaaaaatgcaatccttggcattttgctgctttgctggtaaaggcattctctccctgtagacaaatggacacacgaataaagcttttgaaatccaaattactatggaaacagcccttgtttccaccagcttgctaagtggagcacagtggccacacatcttacgctggagggagctgaagtcacatacaaattctggcttctcaggttcccctttccttgtagacaccccccaatccttcagttagaactttttttcttcaggtgggttacaatgcaattgattgtgattagagtacttaatctattcactataactgattaagttactgcttgattgtgttacagcttcatccatttactgtgattagattgttgctagaaatatatggatacaatcaagcttctgctattgtcaaattcctcagggtgttctgaatttctccacaaaatctttttgtctgttccttggggtatgtcatttccacagataactaatctcatccattacgttttgaatcttcttgattttattctcagaggacaactttatctcaaaactcctggggtgactttcctgctctccccagtactaaccatgcctgacaaataacttacggggggcaccaactacgcttttctttgcctttcctacggtctattccttcatctcagagaggtggtggcagagactcattcatttataactcctaacaaagagtaggagacctttgtgtgaatttttcatcaggggcctggaatgcaagttatgccaacatcttcgatatattagaggagcagattacagcccaagaactataatttcttgacacataacctaaagaactttaccagaaatggaaaaacagaactacaaatacctccgtatgttttaattttaaaaaataactttctaaaatatcgtatcatgaagaaattctctttatctaaatgagtggccatgttatctgcactttagaggttgaataaaattgtcacatactttgagatcctcaataacagctttaataatgtctactaaatgttatttgaatatgaacccaggtatctgacaatctcatgtaagcagaacactgtgcagtaagtaaaacatgcttttgacaaggtaaaatataaatccccaaatcccggcactccatttctataacttattttgggggtgaactcctaccgtcttaaagatgaggatcagattctgctgatttgctctttgtacattcttttcataaaactgatcgtctgatattcaagactttcagaaaatgaaagcagaaatcagaggtaagttgagagtggcttattggtatccatgctgataaaaactagaaaacacagaaaaatgcaggaaacttcaaaaagcaaagaccgagaatccaacatataagagctgtcatatcttgtccagatttacagtcatccctttcttatagcataaaatactcatccatgttcatagtaacagcatcgaggaatcaattcagtaacacactggtaccctatctgcagcctaacgttttatattcggctcctaacatgttctggcacacgccctggaattcaacttgcataatgtcgaatgatgctgtgaaaatccgcttcatagacacacaatggaaattaggtactttacatggtaatttttaatggaactatttcaagagaagggtaagagaaagttaaagggtatcaagaataaagcaagtaacctggtaactgagagttaaaaaaaatggatgaagaagccatcaaagattatagaaaggtcaggaatatggagctttgaaaaatggagaggtaacatagtatagcatcagaattctagatcttctgaaactcgcagattaaagatttaagaaggctataaatgaggtagaggtaggatttgatacagaaaatgattaagatataaataagaatctcagcataggcaagatgctggtagggggtatattagaaatgctcaggagtggatgacatgaagagggggaaatggcaagttcaagtcaaggataacaactatttttggccttgggagaaaaataaaatgagaaaatctgaaggaaaaaaagaagcaaaaccaaatcatgatcaggcataactggaaggtaaatgacattctttaaaaaatgaagaacaaattgacaaagtttagggagataacagattcaaactaggaactaaaaaaggtatctgccttgaaataggtttgagaccaatataatcatcatatattctcgtgagaatccatgggattcactgggagatccaaaatcaggattaattgcactcatgaaagaggcaatgaggcaagactgggaaatattttaaaaattatagaaaaacgcaccaaaaagagagctgtgctttggaaataagggcatgcataatataatccaaacggtatcttactcctggaggctcacctcaccattaaggtgtctgaggctcagcttttaacaagtatacttcttctgatcttctaattagagtgtgttcatgagaaacagaaggatacataaggacttagacaacatgttaagaatagattgcaatcattcctgccttaccaattagaattatttttccagatctcctcattaattataaaaatggaaattattgtacttggtgctttacaataaatattcaagcaactggagctgtaaaatataacctggcaatttaagtgatttattacagcagcgtaatgcttgagacatttctattagctgaaaacctgaaatatttctagtaaaatatttaaccaaaagaaggtctctttaggccaagtaaaaccagagcacttgtaactgagaaaggtggattcgtcctcttccttctgtcacaaaaatatcatcaaaattaccttttaccatattccattatataaataacacaactttgtataatgttatacataaaaagaataggaaaaatgagaactgagtgctaagtgaattacttccagtcattagaagaaacatagatttagtaacattgtgtcattgtaattgttatgttatgatacttaggtttctcattaaatgatacccatgtgtggaatattgtcctaagaacaaaaagtgaacaaaataaagtagtaaaatgagcattttaaaatgaccctttttcaccaaaaaggtgttattaaattataggtaattttcaatgcattaatatttttgtggtttctaattaactttctttaatggaaaagtactatatcaccagaaatcacacatcatttcaaaattcattgatagtttatacttattactgcaagatgtagctgacctggtcattttatttagttgaaaagaaaacaataaagccaaatataattttgcatgagtctataatgaaagtgttttggaatgtgtagatttaattgtacccaatctaacaacatcaggcacagttttcaactacagggggaaaaggcaacaaccctgtctctgtacatggcctccttcttatgggaaagtcttgctagagtctcacaatacagactgcattttacatttcttttgatattgacttaaatagcttgttattgacaaaggaagaaataggtcaaagaaaccgttatagtcacatcaagcctgttcagggctgtaaggtttcactaattgtgcacatttctccgaagtgaacggtagcaaatccagccctcaccacatgctctctggcctgcctcgttttgtattgagccatattttaaattacttgtcaatatttataattggaaggtgtcacttgaaaagcctagatttatggatcctctttaaaaatcagagatggatccacattcccccatgggctccctctttctgtaaggtacttgatcactttcgtcccagccctaactattccttgttgtccctccaacactgaaagaacatcgattgtccttaaacaactttctagctcacacccattttacttctcacatttatgtcacctgcctggcagtgcatgtgtgtttgatgcccactctacgagcctggaggattagctttgtcatgccttattcctcgacccacgatcatttcctagagtctaagtctgcattatcttccagataccatctctcagtgcttggaataactttgaagatttttctgtcttttacgttgtaaatttaacctgcacagtgaaaagatgtggatttattttcattcagcttccttacttaatccattccttccgttaatgttctgttttatatttttaatatccttatgtcctgcatgggaggtgaattccttttaaattaatattttaatttatttagtctctatttaattttgcctagtcccaaggttattgcatatatttagattttgtctgcttttcttttcaaaaatgttatctgtttcttttccctaaccattgctattttaacatgtgtttgctatgttccttcactgagactcctaaacatacttattttaatgtaattttcagcatactattatttgtctttcttccagagtgaattaatctcctgatgtttctgtttttattttattgactgtctttcctagctttgcttttccttatgatgcaggaatttttctgagcccctttgctgggctcgcggtagaagaccaccgcatctactcagcgcacctagccgcgcctgagggcaagtctctggcgcgaatcccacagccactgtgactgcggtgagaggcagcatgtgagtgagcgagtgcggggtctggccagctgctcccagcatcaacataggagcaggctccatgtgcggcccgcggccaaacgaggtgtcaccccaaggggaatgtggtgacccactcaggcagggatgcccgtgaccccgaagccccagagggggtgtcacagtgtgctaattagctcttttagttctgctccccacagcccaatggacagtggtgtgttagcagctcaatcagccccttgccctgctctagtccacggctgcgggactacctcggccccgccactgcttccggtgcatggagcagctgccctctgctggcaaaggcagagggccacagtgttgcagcctttccaggcacccatgtttgctgggtcctgagctcttgtcccacattcatgaagaatgaggtcatgctgacaactgaagggtgatcagggcagagaattttattaaatgacaaaacagctcttagtggagaggggacaggaaggtagtctctcacctgaagttgggtcatctcccccagtatggctgagtctaggatttttatactcatagatgggggaggggcgggccaaaggtagtattggaaaacgtaacattccattggttaaaaagcattattcagaaagaaccaatcaggaaaggacaggcaaacaggaacggaagttcccactctgggtcacgtttttcatccggaaccagcagtccagtctttcagccttcaggctgtttttgacttgaaggtgggatatcacaagggaccggcccctatctgcctaggcatttgactgcctcctgtcacttatcactcatatgtttaaatttttattttgttttaggtaagtttatatatcctttttctacatttgggtttttttttttttttttttttggcattttcttttgctttaagggtactctttatatattagcttaatttgcccatagtgtggtcaggggcatggtgtgttagcacttccccgagtgtgtgcaaaccgggccaggctgtgacagcacctgggcttggccccaaccgcactctaatatcagagtgggctcctggagtggggagaggccaggcagtaggaacagagagggctttcctgggcccggagggtgcagactacagagatgcctgggtcctgtgcctgggagggcgggactcctgcccactccatggcgcatgcaggcagccccggccacacctccttacagcctggggttggggctccaggtcctcactgggcccctctctgtctgcccttccatgcctgactgggctgctcccctgcaaacaggtggcttagcctggccccatcgtggcagcccccagggcaggaggctctgggaggtctcccacttgtccctggctcccaccggcagtgtggaacatggcaatgccccaggcccagctctgcctccttcctgcgtcctcctcacagcagccagtgtgatggcagtggctgccctggacggtccgccgctgccatcatcagcatctctgaatctaaattgatcagaaaacactctcaatcacatagttggtctcattttaaatttaattatttattttatttttgtgtagagacagggagggtcttactgtgtttcccaggctggtctcaaacttctagccttaagtgagcctcccaccacatcctcccaaaacactgggataacaggcatgagccactgcacctatagataaaactatagatttaaaatattaaaataaaactatggatttattttaaatattctcttttgtcctagaacatcaaacctctaaaagccttccatatcctcactttcaattgtctatatcctatgtcactaaagaaacagaagcaatcagaagagaacttccattagcttcctctgtcaccatctacccacctgcattgagcaagttaaatcttattagtgtgcctcctccagagaagtacttcttcagtggcagtgttttaatgatgtaaagaagtctttattaatcagaaagaaatcttacaataaataatttgggaatgcaaatgtctttatgatctcatacaattttattattccaccataagtactattattttagatctttgagatcactgataaattacttaaacatcatagtatattacaaagttgaagtgtcagtcgcttcgtgagcccctgatactgtcttcagcattgcccttcttagaaaattgattcattgactgttttgacctcattgatcttgatatatctccaacataatttcagggatgcattataactgaggctgatttgaaattattttctcttaaatagcatcacagaatgaacctgatattaggaaatctatgacattaagtaacattttttaaaagactttttacattcatccctcaagaagtagagcgcatgtcctttttctagcagctgcaaatgacaacctgcacaagttcaacaatccacaactatatacatggctactatgcatgaatctgatgactgcaaaggattggaagaaaagttataaataggtggtcagggaaatgtcaccttagttctgagactatagaaaaacttttcagctgtacctggagaatgtaaaaactactgcttaataaatgagtgtttagtcaaggagagagggtttttcgtttttcatactctacttgatcttaacgggctcttttatttttcaagagtagtctatgataacttactttggcattctctccttgagagctaaaattctgtaactctatcaagctggttgcttattgctcttctgtgaatagcatactctgtccaatctatttcaaaggacaatactccaggcataacatatgatgcaaatataatgtggcgatctgactttcaagaggtatttcctaagaagcacgtttaagcaagagcagcatgccacaatcagcccttgtatgtattatatgaaaccgacttaagtgttacagagtaaagtaacaaacttaactttctcaaaaacagatcatatcccaaagattgaaaatatcttgttctctacaacttttagctcataagctcaattctctacctttccctgagcatggtttgatgctccttagaccccaaatggagaagagagtccttctttcatggtttcagctccacttaagagattcatggtaggtggcttagtcctactgctacaacaaaaataccccaggctgtgtaatttataaagacaatacatttcttactcacagttctggagactgagaagtctgagatcaaggttccagtagatttggtgtctggtgaaagcctgatctccgctaccaagatggcacctcgttactgcatcctcacacggcagaaggataaggcagctctgttcagccccttttataagggtattaatcccattcatgaggttggagccttataaaatgacttgtttcacaaaagaccccactacttaataatatcaggttccagcatgtgaattttggggggatgccaatattcagaccatagggacaggtttctcccactgttccagatatcaaacctggaaatgtacattgtataacacacccaagaccaagaggataaacagaactaaggaggtatattaggagatcctcattcaggcggggcgtggtggctcatgcccgtaatcccagcacttcgggaggccaaggaaggcgaatcacctgacatcaagagtttgagatgagcctggccaacatgtttctactaaaaatacaaaacttagctgggcgtggtggcacacacctgtaatcccagctactcaggaggctgaggcaggagaattgcttgaacctgggaggcggaggttgcagtgagccgagattgcaccaccgcactccagcctgggtgacagagtgagactccttctcaaaaaataataataataaataaataaatgtttaaaaaaaaaagatcctcattcagtgtgtcaaacataacaatcacctgatataactataaagatagcagtcagccaagttatcacaaagaatttttaggcaataaacaacaacagtaccaagcaaagcatgatgtgctttctaacattcctcctcaagacctagcctcttcccaaccccttagatatcatcacatatgtgtcagtagcagtcactcaatgacagcatctcagagtaaattctgactccttgctgtaaaaatcagaacaattttccctacagcggtcaaaatgtttgcatcttcctctctacatatcagaatcaaatctctggttcaggtcacactcatctatctcatagctgaatgactgtaattttctccactgtgaaaatcatctctttggtctttcagttctgcttgactatgtcaaaatcttactggcttcctttggacttctgtattaaattccatttccgctccctcggtttctttctgtttactcaacagcattacagcactcatctagccaggctttgccacctgccccttcggtttagagcagcagttctcaaatgttttgacctcagaactcctttacatttttaaaaattaatgagaaccaaaatgttgatgtgtgttcattctatctatcactattcattatattaaaaattaaaatggagacattacaaaaatatctacttataaacccttcacatgttgacataaaatatttttattaaaaaactattttttcaaaacaaaaacaaagcaagaagagttatattgttttatatttatgcaaatctctttaatggctggcttaagagtgttggattcttatttctgcttctgaattccatgtggcaatgtcttcttttggtttaagttcctaaagaaaaattccacacatacttcacacagctatgcaactggaaaagagaagaatattttaatcgccttctcagataatgttgaatttccttctttgatatgacaccaaaacttgacaagtgataatttcttaaagcaatatgcaatgtagaaactgaaaccacatcaatgaacttgtttttgtgtgctgcatgaagttccactgctctgtcttgtgatcaaataggggtcttttgttcatgcataatattgtacatccaggcatttggaaaatattgactaattgattatgcagctcttacaaatgttgatgattttattatacaatataaaaatacttataattactgatctcataagaaaagtctctaagtagtgggaagctgttaaatcccatggttgtggatgtatttcaaaatgtaatttgtacatgaaagctctaattttactgctgacaataatacatactgacagctattcccttgaggtatcaggcttacatcatttattttcaataaaatctctgccaaatatccaagtctgtatagtttgtgtgttagccattctttcaagtaaaaagagtgtttacgaaaacactggctaattttagctcacaactcaatcacacaagtgtttttcctcaagacatactttagtatgcagcagatacaattcatgcataattctcattttgtcaaagaacacaaagtgaagggttgacatttaatcaaattaatatttttcctgcttcatcatcaaggacattcttaagagaaactaatttttttttttaactgcaagtgtgtagctgcaaaaacaaatgatgataattagtacaatttggtgtcaccgtcttgatgtgtgctgaggcaccagcagttttacccatcattgtttttgcaccaaatgtcaacacagagaatcactgcagatatcaacacaaggaaaaggcaaacaatgccctagcattactatgaaaagagttatgacgtcacagaccatgtgagagtgtttccggaacccccgggccccggtgcaccacacttggagaagtgctgccttgatgcaggggatttcaaaccctggttgccaattaaaacaatgtagagagcttttatatatacacatacatacacacacatacacacacacaaacatatatgcatacatatccatatccatatattatatatacatacatatatacatatacattacatatatacacacatttacatacatatatacatatacatggacattacatatacacacacacatatacttacatatcttgagatgcatctatgtttctcaggctggtctctaactcctgggtttaagcaattctcccactttcagcatcccaagtagctaggattacaggcgtgagccaccacacacaggtagcttttaaaaaatacatatgctgggccgggcgcggtggctcacgcctgtaatcccagcactttgggaggccgaggcgggcggatcatgaggtcaggagatcgagaccatcctggctaacacagtgaaaccccgtctctactaaaaatacaaaaaaattagctgggcgtggtggtggctgcctgtagtcccagctactcggcaggctgaggaaggagaatggcgtgaacctgggaggcggagcttgcagtgagccaagatcacgccgctgcactccagcctgggcgacaaagcaagactccgtctcaaaaaaaaaaaaaaaaaaaaaaaatacgtatgctggccaggtgtggtggctcatgcctgtaatcccagcactttgggaggccgaggcaggcagatcacaaggttaggagttcgagaccagcctggccaagatggtgaaaccctgtctctactaaaaatgcaaaaaattagccaggcgtgttggcgcactcctgtagtcccagctgcccaggaggtggaggcagaagaatcgcttgaacccaggaggtggacgttgcagtgagccaaaattatgccactgcactccagcctgggtgacagagtgagactccgtctcaaaaaaaaaaaaaaaaaaaaaaaaaaaaaaaaaacatatgcttaggtcccaaccagaccactgaaatcagaaccattgaaagtgtggcccaggagtcagtgttttttttttaaaggttcctgggtgtttctactaagaacaaggttgagaaacattggtcttgtctctatggtatttgaaccagttttgaatgctatggcctcttcttccttgttttattattctaactttccccaagttctttgatgtgctaagcacacttatctatgactcttctaactcattcaaatcttacattctttaagaaatcttttcagactttttttttttttgagacagagtctcgctctgtcgcccatgttggagtgcagtggtgcgacctcagctcaccgcaacctctgcccctgggtttaagcaattctcctgcctcagcttcccgcatagctgggattacaggcacgcaccactgcacccagctaatttttgtattcttagtagaaacagggtttcaccatgttggccaggctggtcttgaactcctgacctcaggtgatccgactgcctcagcctcccaaagtgctgggattacatgtgtgagccaccacgcctggccagtgatgcaatcttggctcactgcaacctcctcctgggatcaggtgatcctctcacctcagcccctgggtagctgggactacaggcacgcaccaccaggccctgctaatttttttttttttttttttttttttgtatttttgtagagatagtatctcaccatgttgcccaggctggtctcaagcacctagactcaagtgatctgttcacctaggcctcccaaaatgctgggattacaggggtgagtcacggtgcccggccttaaaatgattattaattaatatatgaacttgttgttggaaaagaatatacatttttcttatattttctaataagaaggtacagaaaatcatattgcaatttattacattgctcctcccacatagcactttgctagattttgaattttacttggtaggatagtctggcatcatatggacaaagagttaaacttgtttctataaatgacaaaatagctctctctatatgagtgacagaatttcctgatgaaaattagaccatgaagcaaaggttaatagtaagtataataaaaataaggtttcctggccaggagcagtggctcatgcctgtaatcccagcactttgggaggccaaggtgggcagatcataccaggtctagacattgagaccatcctggccaacatggtgaaaccccaactctactaaaaatacaaaaattaactgggcatggtggcacatgactgtggtcccagctactcgggaggctgaggcaggagaatcgcttgaacccgggaggcagaggttgcagtgagctgagattgcgccactgcactccagcctggcaacagagcgagactccatctcaaaaaaagaaagagaaagaaaggttttctgtttataacatcgtttcctatgaaaaacctaaaacacttatcaagacaacctattattttttgatgctaaccctctcatatctgagcaaactcttcccttaaagaaataaaaatggccaagactctcggatgactaatgacactaagagagctggtgtcaacaatctgtatccagttcacgggccacagttcactagcctccagcctggttgataaaactatgccccgtgataaaactattcacaaaatatcatttgaacactttactatgtggaatttaagataagaatttggggatgggggaaaaggtatttttctcccttcatagagattgtagttctcagctgttaccaaattgtcgatataacacgaaagagtgactgctctctttcagagtctgaaagagaaagagaattcctccaggtcagaagaagaggataatgattttttaagagtatatcgagagattgatgacatgaagaagaatttcaggcaggcaaaggaaatggctggaaataaatgtctcaggcataactggttttccacagttgtctttcagagctgccacagggaacaacttcatagccttattgagcatgaagcagttaaagtttccattaaaattggctaaattaactctcccgatgctttcggacaaatagtaaaaggtcaggcctgatgtttaactgacttcataatatctgcttttcttttatttattaatattattttcactttcctttttattaccattgtttcaaatatgttatttaaagtaactacacatgagaatgttatgaaatagtgaggcaatattaaaccagtccaagcatggtgcttctttccataaccacctttatatctaattgcagtcctcgccttcctgttttcttattggaccactaggctggaatgtctaagctgtgtaaattcaagctcactaggcttttatctttgacagtgcctagtgtcactttgggaatatcttggggaatatgttacatctgcacatttttttttcattttattgtcttttcttccttgcaaattgttacctaatgacacattaacttgtcagattatttggttactttctgtttcaatcatttctattaatttaatttttcacatccagttttcatgtttaccgagcaattttgatgttcagtttgttttactttccttacactacaaatttcttgtttgaaatctcctgccttatttccagtttttttttaaatcccttttccctccctttcttttccctccttccctccctcccttcctccctttcttctttactgtctttctctcttttttcttccttacctgcttccttgcttttcttccttacttcaaaatcatagggaaggctcacagatactcaacaattattcaattgttacatattcaaatggtaagcatgtaaatgcttaccatgtcctaaacactgtgccaagcccatacatatatatttttttagttctcataaccattctctgaggcagaaattatcattcccctcattttgcagatattaaacctcaggcttagaaagaacatgtaaactgaccacgtaagtcagtggcagagtcatagacagaattgagctacgctgcctttccccatagggtgagattctcaaccattctgcctgtaactctatctctgactatagctgcaaagtgtcctctaaaaaagaaaggataactgttcttgatgatattcacctcagaaaaattaaagtttattccaaatatcagaggcttccattaatagtattttataagactatgatctataaatgtgtccaaagccaacctgaagtcatttatgttttttacacttactatctcaaaatggtagacttttctagaagttttatatacatcctattagctgctcttccttttagacctttaaagtttccctcattcgtcacccctttcacctgcatggcattttgccggctcactgccacatctcttcactcccttcccttccttctaacatttttggcttctgtcgcatctcttctccacttcaactttccagagtcctaattcagttagtcaattgtcattcactgcctctgctttctcttgatttctgtaattgcactccttatgacccctttcccgtccaccatattcttctgaaagtacagatcaaatagatgtcccaacttatttcagacaggaaagctttgattgggcaaattatattgtaagtactgtgagggctgggttgaaagaaaaatatgagactgaaagcaggaaagctcttgcaataacatggataagaggcaatgaggtctgctggggggaaccgtgggctgtgatgaatggaatgcagacaaatatggggtaagatccactgccgcccacttgccagctcggtggccctgggcaaatcactgaaggtctttgagctttagtgctttcattttcaagataaaggttgtaatatctatcttatttgttgcttcaagcatcaaaggaaatacatttattttggcttataggagatgctccagaagttgcagtcttcacaatttagatttggggcaattcggttgcaaagagagatagataagggaaacaaagacgagaagaataaaagaatgccagtaggttcagtttgaattatctctggctttctaaattcctagattgttcctaacctgccacaatatatgtgggttttctttgtcttgttttcatctggaaaaacttaccatctttgaaaagatatgtttttgataatactagcctatattacttgccagttaactgctatctgtgagtttctctgtataggaagttggaggggggtagtgatgggaaaagaaaaaaagcggtagcggaaggcagaaaggtgggcagaagaaagatgagagtggagggtggcagcaaaggcaaggtgttacacaatctttctttttgattcatagcacacacttttcctgagtttgctccgggttgttttcaaagagtgtacagatttcctgctgattattgactctgctttacaattccagcgttttgtcatagtttgttttttaaagttgagtaaccaagcacatgtacctttgtctatgccgctaatacctccttagtcacataacagctgttccctgggtctctcctatagtgctgtgacacgtttgtacccagcaaggaaatcatatccctcagtcatcattactttagttctaatcatttgcatttctataatctctcctatgatacacatttgtatttcagaatttcttgccctagttaatgtgggagaattagctagaaggtaagttatataaaaaaatctgttttcttccttgtaattgtcatctagaggtctcccctaccattatatcccttgaaattctgagtaactactgtatatgcttgtatctgagtctcttgatcaatctcagggaaaaaagcatgctatagtattattattattattattattattgagatggaggcttgctctgttgcccaggctggagtgcagtggtgcaatctcagctcactgcaatctccacctcctgggttcaagcaattcccctgcctcagcctcccaagtagctgggattacaggcacctgccaccactcctggctagttttttgtatttttagtaggaaagatgcgggaaaacacaaagctgggctagggtggtctggattaagagagaggccgtgagttggggaaatcaaaggtttaccaccttccaaaccaccactatttgcagccctcctgtttgtcctctgctagccaatgcttccccactctcccattctgcctgtgggttgccccctttagtcctgacctccatcccatctctcctccttccacccatcccaatcaaatatctctaatttggtaattaagaaggatgttcatctaactagaatattcacaccagcgaatggatgaggcttaaccccttcagagatcatttccattttaaagctgtaaaaatgaagaaagggaatattgggaaagaaatggccagatcctgcatttttggtgaccccatatctgcttttctagagggccaagagatgaaaattattctggctgcataatttatagctatatggatttgaattgttgctttcctcttgcttctctctgacttgaccaagcacgtagctaggcctttgtgccgctgtgcacgagggaagcttcatgcagaaggaaggcggggagtaagtgtggtttgtggtgaactctttctcgtgatctttgttttcaagaatcctgagctcctctaggggtctgtactagagcagaaggcagggagaccagggcctttgagcacagtgctctagaaggaaactgctgcagtgtgagctcggtggactgtactccagttagagggtctcagctttgtcccaggctgtgaggggcacaggagtaacaaacctgaacctcagaggatacgtgggtctgaacatgaacacgtgtaaggcatataggtgggctggtcataggaggactgtccccatctaggctactctgggtgagtctctccctgcccaaagaacgttgaggaccctaaactagaagggcactcaccgtgatggagattgaattccccattaggcaagttagaagggggctcagagactaatttgtcttcaagtaaacaacattttttagtatatgggggtttgtggattcaaacttacactctacaagaatcaactttagagccatgtaaaatctcctttcatcactagcttgtaaatgatcacaaaacaaaaagtagagtaaaattcacaatcctctaggcagcagtgcaggtattactatatcttcactgtctccatgttctctatatcatcattttactcaaagctaggctttgaggaatcagtcaggtttattttaaaactgaaaatacaaatgttaacaacgtcttttaaaaaaccagagtgtctcccaatagtcctagctcagctatttcatttttacatattacctttcactggcataattttacacatttgcaattatgtcttgcagactgtttcttttctttctcaaagcctatgagggttaatgcttcaaataacctgctgaacttgagaagaactgacagaagatatctattaattaattagctccagagaatgctagaggaaaaataagagtggcttggtctggtcattgtatgccacacaaataaaggctaaagggagattttaaagcatatcactggttaattgcatactattcaaatcctgaactaatgcttttttccctctacttttttttctgccacatattttctttcctgaaacaccttgggttctcctaataacctggatttttaaatacgctcaggcctattctggccaaatacctgaacttacaagattcctcttttgtactgtcctgttgctcttcctgcgtttgcagattgatagaataagcactggaggctgagcacggtggctcatgcctgtaatcccagcactttgggagaccgaggcgggtggatcacttgaggtcaggagttcaagacctgcctggccaacaaggcgaaaccccatctctactaaaaatacaaaaaaattagccaggcatggtgccaaaagcctgtaatcccagctactccagaggctgaggtgggagaattgctggaacccaggaggcagaggtcaaggaggctcactgcttccttgaactcaggaggcagtgagccaagatcgcaccgctgcactccatcctgggtgacagagccagactcctcaaaaaataaatagagaagccactggataaagcaggtcttgattctagttctccttctgcctacttttaggagcttggtaggcaagccattcagcctttacaaacctcatttgttatcagcaaaatgtgaattacaaatagtgattctatctacctcccaaggtggttgttaggatcaaaagaatcaaatctgggaaaacacttgaaaaactttaacatggaacacaaatgtaagctattgcataagaccaaattaaatatcttacatttaattgtactttttcccatctatcagttataagcaggtcacctgaatttaaaaaataactgatacagagtaatgtgtgtgtgcataccattctggccatagagcatactgagaagacaatattataattcactgcctagtaccattagttagaatgttttcaatccaaccaggtgatctactttcttcccaagcagcttttaaaaaaggtaccaaactgccattaagtgaaaaaaataaccattttataaacttcacagacatttactcctttatctttcttgtcatttgcacagaaaataaaatttgcacagaaagcactgagttcacttacttgagaagtgaggtgattcggttttctcttccctttggaatcaccactttccttctgctgttattctatgtgggcttcactaatcatagaatggcagtttcttaatcaaaattgttttattttgaacacaaaagcaaattaagcagattttttaagagatggaatcacacagagtttatcttacctccaaaggaatggattgggtttggtgtttgagttttattaggaaatttatcataaactcaggtcagatatattaataagtattatatttggctcaaatgaaagcagaggggaaaatgacgttagggatagtgatggttgagaaataaaagccacaaattatttaatactcctgagcaacatcaaacaaaacacctccaagttaagggatcactttttacacagcaatatttactataacagtggtcccaaaattattttatgttgaacttaggtagttggtaagactaatattcaattttcaagagaccgaagttcctaccccttaggtagttggtaagactgttattcaattttcaagagacggaagttcctactcctggttttatcattcattaacctgtgagctagccaaagtgtcatttaaatgtgctgattcctttgtctataaaatgggaatgtctattattttaagttattataaagttcaaatgagaatacatgtaaaactcttttcaaaagggagcatgtggaagcattatcattattctcgatttaaccaataagaaaaattgtaatgttaatctcttatagtacagattttgtgtttttttttacaaatcaaattttccaagaaatgtttaaggtgttttcttattttccagagtaatatttattgttagattgagggagtgggtggaaagaatacaaattcaagtcaaagtacataaaagcatatgcctatttaaagtttcattttctttcccattcttattgtgatattactcagcatgatgtattacgggctttaggggtgatttgtattcatcgtaaaattttctctcagtactattagagcccattgtgggatgcttaggactgtctgaaagtcatttatcattcagaatttatgataaaaccactgttaggcagcttctagacactctgtcatatttacccttctggaaagcaacatagtgaaagaacatttgggaagtgaccttgatgctttcatattgtgctattgtaaatatcattaatgctagaacttttaaacatccatcctatcaagaatcaactgctaagatgtctaaaaagctatattcctacatttcatttctgactcttttcctcaaattgtaaatgagctgtttctagcaagcatggtccttgatgtggcattggagtctactttttagatcactgacatttactaaggcctttcaagaaatgaaggccacattcttcagactgtatttctggaaattatgtgcatatttagctggatttgtttttctgtgcaaggaagagactagagacttgctgtgcaacgttattgggatgcccccttgaataagtctcaaaggtctgagcagctgctcagaatgggaagttgtgcttctttgccaagacaagtatttttcattttctagagtcatagattacattggacagagagaaaatgttctggattcttattgtcccagtgataccaccatactacctaccttgcatgcaagttggtgttgaacaatgcagtgaatctacagtgctagtgtgtattcttcctccttattagggcaatcaagaaaaaacaaaactacctttgtccagaatttaagacgatgacaactctcagttttgaagggtagaaattatttaagtgctatttttttctagcaccaaagccacttcttccgtacaaagtacttagattgtaaaagtttcttgtaaaaaaacacacaaaaaacttccatgattccaaggaagaaaaaatgcaaaaacattacacagtccccccagagagttggatgctgtccctttttcaaggcttgttgctccatttcttttctcctgaccctacccaccaatataaccagtctctccttgcctaacatgtccttagactttactcaaactgttcccactactagtaatgccattacctgatactccaactgttgaagtcctacccttccttcaaggccccattcaaattctgctttctaggtcttcccatatgttctccgatcaaaatgatctgtcttcagatataccttcatgataatttgcttatacttctattaatggcttatcgtcaaccttattttatcattagttatctactgtgtttgaaataaaaaatgggcagcatgttggttgtcaagaattgtggagcatctgagattttatccaaaagtaagctaacatgtttacctatcagattcatgaatgctggcagaagacatgaaactcctgggtcagagacaaaggactttattacacaaagatatagcagtagctggaatatcagcatttgtcccagttctctaaactccagttcccaagggagacacaaagaaggccaggtaacgcctgcatgtgcagtgggttgccctgtggagaggaaccctgaactcacgaagcccaaatcctttataataagaagtaaaccttactaaattttgcctggagacattaatttattattctaaaccacaaacaaacctgtcctttgctccagaggcagctccctttactgtcttccaagtctgttcactaaacaaacatccttagaaagataccccaaaacaaaggtggtctgtacctctgcacctctgtccgtaagacatgaagaaatgtaacagacccagaaaattgattcccaacattagtttcctctatactgcccacccttccccttgattataagcccctagagggcaagaagaatgtcttattatagttctcatggaataaatgctgtttgttcaagaaagtccattacatcttctgagtaaatagaatgatctaccagagatgttaataatttcctatgtcaacacactatttttagagaaatgtttctgccccagctgtctggagaccaatgagaatatacatttttttgacaacacagtctccctgttctacatgagtttttctctttgggggtaactaattctcaggccttccatttcctatttcttctcactccttgccacaaacacagtatttttctacttttattcttgccctcgccaataccaaatcctaggaaaagagtgagattcatttgcaccgggtataaaaagctttagtgtcacccatctgagacttaatgtcaacttccattaagtgggaaagaaataaaaattttgagaatgtagcaattgctagaaaccataataaataaaaatgtttgactgctgttcttgaaattgttcattcataatacattgatgaacatctaccctacctacacacaagagtaagcttcaggaatgagtattcatactacaaggaagttatttacgatggaagtactctgagagtagaaatacagcatttttattatcacttatatatctgctattttaaagctaacacaaagcaacacaaaatggttttgaatcagggacaagaaaaaacattgtccctgctaagacaatcatgtagtagtatatattctttgtctaagacaattcttacataggacaggcacggtggctcacatctgtaatcttagcactttgggaggctgaggtggacggatcatgatgtcaggagatcaagaccatcctggccaacatagcgaaaccccatctctactaaaaatacaaaaatcggctgggtgtggtggtgcgtgcctgtaatcccagctactaaggaggctgaggcacaagaattgcttgaacccaggaggcagtgagccgagatcacgcactgcattccagcctggcaacagagcgagacctcgtctcaaaagaaaagaaaagaaaagaaaagagaagaaaattcttacataactcaaggtttttttcttcaaattaacaccccttctaaacattgagagtgccaagagagtttgaaagggccaaaggggatggtgatgatcttaacagaagaaatatgcctgtatgagtatggcatatttgagtggtgtgagtggtagctgcatggattttataaaaagttcaaataatgcctaggggatacactgcattgtatttaatgcagcatttgcatgggagttgccagaactctcagaggtgctttcatagtgtgtcatttttaaactctgtaggtataaagatggttgtgataattatgggccaattttgctagttaatattcactgcaaagtatcagaccccatatattccatgcctggtgccactccaatattcaggattgcaagtcaaagttaccacctcagagagaacctctctgatcaccagtctaaagctgcatctataccccatcagtcagcctgaaatgatcttagtggtttatttgcttattgataattttctcctttctccctccagcacatgagatttgggagtcttgcctatttctttagagttgtatccctgggcctagaacagtgtctgagacacggggaaaatcaagaaataatcaaagagagaatggatctattgttctactcttttaggccacagtttccattggtatgtgcagttttcttggcagttagcaactgttctcagcagagtgctggccaagtttgctttctcaaaacccacagatgataggtgaaatcctcatggcttgacgaggaaggaagaagaatctttcattcttctctcacagtaactgtggtttcctccttctaatgctattgcttctccttatttgagatttggggttgtgttaggccattttttgcattgctagaaagaaatacctgagactgggtaactgaaaaagaaaagaggtttaactggctcatggttctgcagcctgtgcaataagcgtggcaccagcatctgctcagctcccagtgaggcctcaaagagcttttactcatggcagaaggcaaagtgggagcaggcatgtcacactgcaagagcaggagcaagagagagaggagggagatgccacactcttttaaacaaccagaccctgcatgaactcagagcgagagcacagatatcaccaaggggatgggccaagctattcatgagggatctgcccccgtgacccactgcctcccacctccaacactggtgattccatttccttctttttttcttttccatttcatcatgagatttggagagaactaaccatatcagggtgtttttctgagtatagagagaatcattcctggtaactgttggatttttcagcagttcatccagtccacagaccatcttcccttcagtccctcccaccacatcacacagcctccagcaatttgtggggaatatttgtttacaaccgtgttatgcatatacacatatgtgtgtaacatagattatgcatatttcacactgataaatacaaagaaaataatgataggggtgcagggagaatgcacacctgctgattctcacattttaaaaggaagtactggccgggagcggtggctcacacctgtaatcccagcactttgggaggttgaggcaggcggatcacgaggtcaggagatcaagaccatcctggctaacacggtgaaaccctgtctctactgaaaaatacaaaaaattagccgggcatggtggtcggcgactgtagtcccagctactcgggaggctgaggcaagagaatggcgtgaatccgggaggcggaacttgcagtgagccgagatagcgccactgcactccagcctgggtgacagagcaagactctgtctcaaaataaataaataaatacaagtactaattttatgagggcaatttcaggtaataaaactcttctatttagtaattgggctaggttctataaaatatgagccacatcaaatctcagatgatttaggtcacattgagtttcagattagtctgcctttctgaacctaggcagacttctaataaatatattctggaaaaaaatgcatatatttctctcaccatcaaccccaagaaggacatatgtgatatttttctagtattatttctaacacaagccatccttatattcaccctcctccctctcctgtttctacaattctgctcatttcacattttctgcagaagcagatttccagaaggaaaaatcaaagacctaacaactgctgttagcacaggagttgacctaggaaagggctccgcatttgcaagttggaggcgtaatctacctcgctgtagataactgtctgtttccttctgtggccctagggctttcccaattcatctcgctgatcaaacctggttactcagagcctggggtgtgtttgtgaaggacagagcaggctgtatttagggagaatgcctgttaacacatagaaaaagtgacttagtgttggcaagtctttcatttccctatttatctacattatttctttacatggatgtttctaacatcacaggaagtactgtggctttcttgctgtgtttttgttttcctactcaaccaatatggtcaccctttcctgttcactaaacctaaagcaggaagattcttatacactctccgcatgcttccaggaaagactctgttgcttgttcctttgattgaggagattgcattgcaaataggaagatatcttgagaatgattaggaaaggcttttattctggaaatgctcaagtactgaggtgaagaaagatgaagacctgcagagctgattcacatccatttaattgttatgtagcaggacaagccacagacaaaacccctcagacaccgagttaaagaaggaagggctttattcggtcagccaggggcttcgccggcaagactcatgtctccaaaaacagagctctctgagtgagcaattcctgtcccttttaagggcttacaactctaagggggtctgcgtgagagggtcgtgatcgattgagcaagcagtgggtacatgactgggggctgcatgcaccggaaatcagaagggaacagaacaggacaggaattttcacaatgcttttccatacgatgcctgtaatctatagataacataattgattaggtcaagggtcgatctttaaccaggcccagggcgcggcactgcgctgtcttcctatggatttcatttctgccttttagtttttacttcttctttcttcggaggcacaaattgggcataagactctatgaggggtggtctcctcccttagttacaggccaaataaataccaagaggaaggaaaaacagaaattctcaactgagaatgtggcattttcattgaaacactagtaatcagctaaatgagatttaggggctgatatttatatttacaagaatttttctttcaataataagaaaaggccaggcacggtggctcaagcctataatctcagcactttgggaggcggaggcgggtggatcacttgaggtcaggagttcgagaccagcctggccaacatggtgaaaccctgtctctactaaaaatacaaaaattagctgggcgtggtggcgtgcatctgtaatcccagatactcaggaggctgaggcaagagaattgcttgaacccaggaggcggaggttgcagtgaaccgagatctggccattgcactccagcctgggtgacagagtgagactctgtctcaaaaattaattaattaattaattaaagaaaaacatatttaacacagtgttgaaaatgattcagaacttcccatctgactgaaaaaatcaacagattaagtactctgcactcttatctagtagaagtcatgattcattgtagcatttcagagacattggctttagtttccattttgtgaaaaattaagaaagccagtagcttaaccacaaaaaaaccttgttttatgtgttagctcataatgatatcctaatatcacacaagacagtgatttaatccataaggcaaagagctcaaatttcacacccagctgtcactttctgcctaccctgtataaagaatcacctagtttcctttttaatcttacctctgtaagcaattccttcatctgactcacaaagttctgagggttgtatccttaccttaaatatacggatagcattttcactgagacttaaattatctcactgtggtaagaagataaacatgattcaccaggaaaaacaggaaagttgaacatttaaaaaataatattaaactattataaaacatatatggaaataaaaaaaacaacaactaaacttcaccagatggtcagagacttctaggagttctgtatactcaaaatgctttgaataagataagctttttttcaccaccttgaaatgtaacgacccaacaggttcaccttgcccacagcctggacagagcccgtttatcaagacagggaacttgcagtggagaaagagtaattcattcagagccagctgtgcgggagagcggagttttattattactcaaatcagtctcccagagcattctgggatcagagtttttgaagataatttggcgagtaggggcttgggaagtagggagtgctgattggtcaggttggagatggaaacacagggagtcaaagcgagtttttcttgctgtttcctcttcctgggtggggtggcagaaccatttcagccgaattacgggtctgggtggtgtcagctgatccactgaggggtgcagaatcagcaaattatctcaattactgatcccaggtttgacaatagtgatggtatccccaggagcaatttggggaggttcagactcttggagccagaggctgcgtgaccgctgaactgtaatttctaatcttgtagctaatttgttaatcctgcaaaggcagactggttcccaggcaagaaggaatttttttccagaaagagctattatccattttgtttcagagtcaaaccatgaactgaattccttcccgaagttagtttggtctatgcccaggaataacaaggacagcttaaaggtcagaagcaagatggagtcggttaggttcttttactgtcatcatttcctcagttataatttttgcaaaggcagtttcagaaacacaaaaaacaaatctgaaagcacagaagcacacagacacacattggatcgccagttatgatacagtcattgtttcaaatctttctctccctgtagcagtgagagcctggtctgagataggacctactgtctgacaatctgaaaaaaacagaggaaggttcaagtgccacgaagaacccctttcaatctaactctcaaatgtgtcaactgaaaggttaaataacaagcactgtaacttaaagaaatttaaagtgagctttattctgggccaagtttgaggatgatagcccaggaaacacagagtcagggcaaaacgacaatgtgtccccaagtgggctacacgaggcacagtatttatacattcctcctacgcaggaatgggagaagggggcagtcaagcaaaggcgacaatcttacaattctgtttgttgctcagtggtcttatacataagatacagcaaatatgtggttaaggcatagagggtaaaatgtttaagaacatgtgggcatcttagggccagagaggaatgacctgttctactgtgcccttgtgaatcatctgctaggcaaggctgtaatcagtacaggtcagtgaaatatttgacagcctcaagccttgcagacaaaggttcagctctagttcatgggcgtcgtttccattaccatatatccaacctgtaaccatcttgggctgcttttaaatattttcccttcagattttcctttttctgacatgtagaatgaaatcaagcagaacgctactctgactatctcaatttatatattttctaaaaacaaaatttgacatttgcatggtaatctttcagcaaatttggcagaaaaaaaacccaattcaaatatttcaaaagaattccacctgttcttttaaaaagttattggagacccatcaatgacaaaaaatacctttcaagctctccctcaaacagtgtcacatttaccaggtgacattttcttctacttcacataacttatctgacacaggagcatatcagcaatatactacagggaagataattggaatcaagaaagctaatccacctttctgcttcaactgtcagagaaaaaaaattgaagtcgcagcaaatacttttaaaagcacaagagtagaatgtcaatttcctgactcagcaacccaaacaaaaatgacaaatctattcacaaagccggaagaatctgccacatctggtattcagtggcataatgtgctttcatagctaacttgaatggaagttataggaaagaaagatgtgacaatccctttgccccagcctccatgtaaggatatcatacgtgcataaggggatactgcccaataaattcagctgagttaaagtgttaaactagtactttggtctaacagaccaaaagtttcacaaaagtaattctaaatgcaagaaaggacaatgatttccataatacttgtagaaaatgatgtcacctggccacaaagttaattggaaagcaaaatggacccaggtaaatcttaacacactggtattcacacacccccatcttccttatgcctggaagcagattcctaagcattgggcacaaacacatatgctgattttagaaattcacctgcttgtaagaaaaaaaaaaagctgacttgataaatacattgttcttatttatgtcgtatcaggaagtggatctttgaagttattttgccaaggacaattttcgcaaggtatccctgtctttctgcttgtttccctcccgctcacgtgtgatctctctctctctctttttctctctctgtctctctgtctctttccttgtttctttctaggacgtctctgacttaggagcatctaccaaccttaccaagatgttgcacatgatttccaaaatctgaagggtcatctctcctgggagagaaatgtctaaatatcccctaggccaacagccatggtatgaagcaattcctttcttcaaggtggcagcaaattgatggggtagtgagaccagcaaccagctaggcacagggaaaggccgcccccctgctccaccccagtgcttgccacctcctactcagcggaggaaggggaactgtctttggattccaaggctgatctccaaaaaagtccagaaattaaataaaatagaaagttcaaattcctttatttttgattttctacttttatactaaagcatttagaggggaaataacatctaggaaaatgatttttacaaggaaacttgaatttaattttttttttttttagacagagtctcgctctgtcacccaggctggagtgcagtggcgcaatctcggctcactgcaagctccgcctcctgggttcataccattctcctgcctcagcctccctagtagctgggactacaggtgcccgccaccacgccctgctaattcttttgtatttttagtagagacggggtttcactgtgttagccagggtggtctcgatctcctgacctcgtgatccacccgctttggcctcccaaagtgctgggattacaagcgtgagccaccgccccggccaaatttaatattttataggctgggttcagaatcctgtctcccatcaagatggtaacctattatcacacttgtggaaaacgcctgaggcatgagtgattgcagactaattcacagtctgtcacatcgtactacttgtcatataccaatataaacagataccatatttttgtcactaataaacatgtttttgttatgaaggctttaatgtaattaattctacctgtaacttcaagcccaagaaagtaatttttgatatttgcctacaaatatcatgaatagtaaataagcctgccctctcccgccctttaaacgttaaaccaccctcgtcaacagtcttagctactacatttttgcaaaattcccttatgacaggttccaacgttgctccacaagagtttcattgtttcttttctttcttcttttacaagcaaatatctatggatttcccactaaggtgaatgcattacactcagaactggggagacaatacttaacacagagatagttctccgtcttagcatctagaaaggacaatcacaggcaatgtaagttagtgtgataaatgttatgctgggggtgaacaggtgctgatggagaacttgtgaaggatacctgatcaggattaagggagtcagcgaaagctccctgtaagatgcggtgaactttaaaatagaaggtggagggtaatcaagagtcatcccggcaaagaagggcttgtggttggaggtagagtgtgaagagtggggagttgtgaaaaaatggggttggtgatgttggggctcagaaaacggtaccaaaattgtgttaccagcaggtctttgttcttagagctcccaagatggtgggggggccgctcccaagatggcacaagccttttgttccctgacctggggttcttggcctcacggattccagggaatggaacgttgggccatgaggtgagttgttatagctctattagaagccgtgggtcacagaagagaaccgtggaacccagcgactagcgttcagctcaattaggatgaacctgggcacttagccgcgcagcaacaatggcgagcctctagcccgaccgggagcggcaacgggcgcctcgctggatcaggagcacagcaggcaccgggctggatctggagggtggaagtcagtggcgggtctgcgacggcagcaatcagcagtggcggacggtgagtgaaagctcagctcgagccagaacaaacacggaccagaagagcgcgcagttgcaagatataatagagtgaaaacagagctcccatacaaggggaggggacccaaagggggttgccacaccggatccaatgcctgggtttatatcccggtcattgtctctccctgtgctctcaggcgatagatgattgagtatttctttacctcctgcttttagcctaattggtattttagtgagctgtctttacttcctgattggtcaggtgtgagctgagttacaagccctgtgtttaaaagcgggtgcggtcaccttccccagctaggcttaggaattcttagtcggcctaggaaatccagctagtcctgtctctcaattagaaggcctcagcagcaaacgttttctctgaccttctcctgccctcctgtcctcttattgcattccctaccaaggctagccacagaaacttagacccatccacagggtgtatcttagaaaccagaatttcttttccccaaagccaataataagacctaaacatactactcttaatttgccttcctctctatccgtgtaaaaccgatcataaaaaaattatctgatctaccttgtaaaagcctcattccaaagagggtcctgccccacacccagaaggaaggaaagctgcacagagaggccaagaagaatctaaacagaaaggtcttgcagggtgaccccacccagtctattagcaaggtccaatgaactttccccttagcccctacagcgatgtcagcaaagtccacatcatgtcacattctcaaactacatgaaggattagtaggatcctaggaccaatgtaataactaaaaaattagatgaattacatttgggttataataacattactctggctggagtttagagaatggatcagagaagagccttagactaggggtaagaaaatcagttaggtagctgctgggataatctacatgggaggaaacggtggccaacctacagaatcactggcgaggatggtgagaaatagatggatttggaatatattggaagtacagtgaactccatgattgattctgtttgagtaaatgagtgttgaagttcttgaatagctggatggatgctattgccattgcctgagacagaaaacacagtagaaggaacacattttttgagaaacatgagttcaagttgtacctgatgagtttgatgataattgcgggatatcccagtggaactttccagtaggcacgtgggtctatgagaccaaactttcagcgagagatggagcgtgatggcaggagaagcagatgtgggactcatcacttcctaaagacgacatagagccataggggtcaatgagacagcccagggagggtgtggaagacgatagggcctaggacagagcttcgaggaaggcagacattcaagattaggcacaagaagggaagtcatagaagcatacagaggagcagaagcaattcttcttaagctttgaatcccaccctcttccccaggtcgctcacgccatccattattccttctctactctgaatttttaatttttccctttctactggattctcctcataggctttgaccacactcaggttcctctcatcttaaggaaaagcagccagcctttgactccacccacttccctccatgtattggcctatcctctcctcaaaggcaacttcagtaaattactcaagtgatttttatttactctctctcttgccccacctacagtcatatttagctcactctatctggcttctgctctaagtatattctagaaacaatccccattaaagtcatgaatgatttctgtgtctctaaattcaacagatattattcattccttaacacttcatcctttttcttttttctttctttttttttgttttttgttttttgtttttgagacagagtcttgctcttgttacccaggctgaagttcggtggtgcaatctcagctcactgaaacctccacctcctgggatcaagtgattctcctgcctcagcctcccgagtagctgggattacaggcgtgcgccaccactcctgcctaatttttttttttttttttgtatttttagtagagatggtgtttcaccatgttgaccaggctggtgtcgaactcctgacctcaagtgacccacctgcctcagcctctcaaagtgctgggattactggcatgagccaccacgcccggccacttcatcctttttgaaatacatcctgttttcctttggacaggtgtaaggacaaacacaatttgaaaataagaggcttgactgtccctgatgacaattaagagaagagatctttctaccccacctcctttatctcaggacacttactttagaattaaactcctgagtaccttttcctgttttgaaatgtatataaatccctggaagattaataggccttttgtcagctttatgacctagggaatgtctttctcaaagaactgggagccctctctttgcaatgtaaacatctggggagatagaaacactgtctcccagtttctgtgttaaggtaggggcctacatttagtgagtgcctctctccaagttggaaaatgaccttctgtcataaagatatgagaagtttgttttccctctagaccatgccatatttacccatcacacatgctcatcccaattaccagatgaagtgagggtgagctataagtgacaaatggtgctggtaagtcctctaactctaggactagttattgtttaacttgagaatgagaatcggttgtgtctgcttggctatagaaaaggctgagatttctttttgtcttttcaatttcttagcagatcgcctgtgaggcttgcttgctcaatactttttaaaaatgttttctttctcttcttcctttgtggagaggatttctgagttgcaagaaggttttgttttaaattatatttcccctacactggttgtcaccaacagaatgtcaccattttccattctgtgtaatattatctttctgtctaccgaccatttttttttaacacactgcagcatgatttttcaaatgtgaacgtgactacatcaaagcccaggtccatctctttccccttactacttatttaaaatactacagtgatcttagcattaaaattacaaccagtaatagagtttgcgcaggcctacaatctcgggctttatcttgtacccttcttgtctctagccacactaaccttctagtttctcaaatgtgccgcactccttcagtctaaacaagtctcccctcttcagcacccccagctcattttgcttaattaactctattttaccgttagaatctcagctcatgtatcccatcttgaagggaagcttagctctcacaaaagcaaggtcagattttcctggtatagttatcacagctctgtacacaatttttttttgataatcctattgcagattgttttgtgaaattatttgctgtcttctccatttgactataagctccaagagggcagggtctttatctgttttaacttaccgttgcttctccgtggcctaatacagtgcctggcatatggtaggagttcaagaaaagctccattcatcctgctcctcattggaacaaaatgttgccatgctatgcaataaatgagaaaaaatttcaggaagttcaatgttaatttttttcagttgttagcttcctttcgaatcaactataaaggtatgtagttaagaaatctactattttattaaaggtgtttcttatggattccatttgcaaagtcagtattgacttttgacttagattactgctgtttattgattactgtgtaactaattaacccaaaacttggtagtttgaaacaggagttgacgaactttttctgggagttgacaaactttttctgtaaagagtcatatagtaaatattttagagatctctgttgcaactacttcactctgtcatcgtagtacaaaagcagccaacaacggtacacaaaaaaataggtgtggctgtgctccaatacagctgtaccaatggacactgcaatttccgtttcagatgattttattatgtcacagatattattgctattttgattctttttgcaacctttcaataatgtaggactcattctcagctcacaggctatacagaaacaggccatagcctagatttgacccataggccatagtttgccaacaataatatttttattatctttgactctttgggggttaaggattaagacagatcatagcaggttgattctcctgctcgtcttgatattgacagaggccagttggtagtattcgtctttggatgtgttggcctggcgagtgtaagaaagctttttttttttttcttagatggagtctcactctgtcacccaggctggagtgcggtgctacagcagctttattcgtatttctggcaccttggtgggagtgctggaaaggctgagctcagctgggattgtgactccaatttctggactttcagagagactggagattaccaatatacattttgatagagggtatgatcttttccacatgtaaaatgagtcaggtttggagaggaaggaatgatacttatgagcattaacaaagtacaatggtgtagtggtgtaagttcttcggtttcctcataagaaagtgcttatgctaatgcacaccgtcaggttttgtagcactgttcgcttttcatctcatcattttcttcttttttcttcatccttcaattgcctttccttttcagttcaaaacaagcctgcagagtaaatgctgaagcataatcctgtattaatttatgggccatggtgtggcttactagaaatgaaatgctctggtcccatgaaatcctaatcactttcacagccagcaggtgccagagttaaagcatttccagtgaagtgaacaagaacattaaataaaacccatgctcaggactggatgcatttaagtcaggaagaggaaagtactgtgttactgatcaaagtctggcccagggaggcaactctatttggctttaactcagtgggaaaggcagtaacttcaaatccatggtcagttcaattcaatttatgagagacttacccagttatttctgtattgcatggcaagcagcgaggctctgagctggcttatgaaagatctcccaggtgaaagagatatagaaaaattgccccccatgcaagttctttcaactatccctgaccctttgagccattctgtggaagtagatcagaatctcaagggaagggggaaggcatctgtgtttggaatggacagtcctggtcccattccctggtgaaaatttctctctcatgtggcacaagtggtgggaaaagccctctctattaactactgactaggagttgccaaaagaaaagcaggtttgggggaaaccccaacttatatgtgctgagattaatgaatgaacttcctgaatagacaagtgactgagaataattttctaaagtgtacatacaatagatataaagatatctttaaagacattgtaagtccaaaagatgctgaataagggataatttaaaaataatatgattaaggttaattctgatgattgattatgtcaaccaaaacaggttctcagagctgacaaacactttccatatatcttaaacagcagagggctgttatagccaatagaatggtgaagagaaatagaatgataagccaaaaactacagacaatcagaaaattgttgatgcagtattagatttggaatatctgatatgaacaccgtggcagaatatgtatcttcttaatgatatttaacttacaaaaatattagaatcagcttgctttccctgcgttctacttatgatgtcatgcagaatattgcccaggttttgattttgacagtagtcctaattttgaatgccagttttatctaaaaaatgattttataaccgattaaaatagcttgggtaatgtgtaagcataatagcataaaaatttttagaattaaattaaagttactaacattgtcttcattttcacttctaagtttaatacagtacaggcatacctcagagatattgcgggtttagttccagaccaacacaacaaagcaaatattgcaataaacttaatcacacaattttttttggtttcccactgcatataaaagttataggccaggtacagttgctcatgcctgtaatctcagcactttggaaagcagagacagagggatcacttgagcctgagaggttgaggctacagtgaaccatggtcatgccactgcactccaacttgggcaacagagtgagaacctgtctcaaaaaaattatgtttacactatgctgtagtctattaggtgtgcaatagcatgatgtctaaaaaaatagtgtatataacaatttaaaaataggccaggtgtggtggctcatgcctgtaatcctgacattttgggaagccaagcctggaagattttgctggaggccaggagtttgagaccagcctaagcaactgagtaagacccccatctctacaaaaataaataatgattaactgggtgtggtggtgggcacctgcagtcttagctactcaggagactgaggcgggaggattgcttgaggccaggagtttgagaccagcctaagcaactgagtaagacccccatctctacaaaaataaataatgattaactgggtgtggtggtgggcacctgcagtcttagctactcaggagactgaggcgggaggattgcttgaggccaggagtttgagaccagtctgggcaacatagtgagacctcttttctaccataaagtaaaataaaataaaaatactttattgctaaaaaatgctaaaaatcatttgaattgtcagcaagttataatctttttgctagtagagggtcttgcctcgatattgatggctgttgaccgatcagggtcgtggtggttactgaaggttggggtgcctgtggcaatttcttcaaataagacaacaatgaaatttgccatatcgattgactcttcctctcatgaaatatttttctgtagcatgcaatactggttgatagcattatactcacagtagaaattttcaaaattggagttaatcctctcaaatcctgtcactgctttaacaaataagtttatggaatattctaaattccttgttgtcatttcaacaatgttcacataatcaccaagagttgatgtcatctcacgaaactacttttttgctcatccctaagaagcaacttctcatctgttaatgttttatcatgaaattttagcaatgcagtcacatcatcaggcttcacttctaattctagttcttttgctatttctaccacatctgctgttactttccccactggagtctcaaacccctcaaagtcatccatgagagctcgaattaacttctttcaagctcctgttatgttgatacttgaccccctctcatgaatcatgaatgttctcaatgggatctagaatggtgaatctttcctgaaaggttttcaatttactttgcctagacccatcagaggaatcactgtctatgacagctataaccttatgaaatctatttcttaaacaattaaacttggaagtcaaaattactccttgatttatggactgcagaataaatattgtgttagcaggcaagaaaacattaatctccttgtacctctccatccaagcttttggatgaccacatgcattttcagtgaacagtaatatcttgaaagggatccttcttttctgagcagtaggtctcaacagtggggttaaaatattcagtaaagtgggcttaaaatatgctataaacaatgtaaaaaaagtgggcttaacatatgctgcaaaataagtagatatgctgtcatccaggttttgttgttccatttatagagcacaggcagagtagatttagtataattcttaagggccctatggtttttgaaatgataaatgaacattggctttaacttcaagtcaccagctgcattagcccctaataagagtcagcctgtcctttgaaactttgaaaccaagccttgacttctcctctctagctaagaaagtactagatagcatcttctttcaataaaggctgtttcatctaccttgaaaatctgttgtttagtgtaaccatctttaccaattatcttagctagttcttctggataacttgctgtagcttctacctcagcacttaccacttcatcttgtacttctatgttatggagacagcttctttccttaaacctctgatggcttccaagttttcttctcctgctttcttacctctctcagcctttataaaattgaagagaactagggcctttctctggattaggctttgacttaagggaatgttacggctggtttgatctcctatccagaccactcacactttctgcgtatcaacaataatgctgtttctctcttttatcttttgtgtgttcgctggagtagcacttttaatttccttcaagaacttttcctttgcattcataacttggctaattgtttggcacaagaggtctggcttttgacctattttggttttcaacgttgccttcctcactaagcttaatcatttctagctttttatctaaagtgagaggcatgtgactctctttcacttgaacacttagaggccattataggttgttaattggcctaatttcaatattgttttgtctcgaggaacagggaggctggaggagaagagagatgggagaatggccggagggtgaagcagtcagaacacacacacatgtatcgactaagtttgctgtcttatatgtgcacagttggtggtgccctaaaacaattgcagtggtaacttcaaagatcactgatcacagagcaccataactagataaaataataatgaaaaagtttgaaatattgtgagaattaacaaattgtgacatagagaaacaaagtgaacacatgctgttggaaaaatggactgatagacttgctatcaatgcaaggttgccacaaaacttcagtttataaaatatgcaatatctgcaaagaataataaaataaagcacaataaaatgagatatccctgtatttagaattttttttttttttttttttttttttttttttagagataaggcctcactctgtcacccaagcttgagtgcagtggtacaatcatagatcattgcagcctcctgagctcaagcgatcctcccatctcagcctccagagtagctgatactacaggcatgtacctccataccaggctatttttaatttttttttttttgtagagctgaggtcttgctatgttgcctaggctggtcttgaactcctagcctcaagtgatcctcccaccttagccttccaaaatgttggaattacaggtgtggatcaccacacctaaccagaattactttttcattacaaacgtagtaacagtcacagtagtcagtgtggcaatccaaggatgcatgtagcaaaatctacaaaacgcatattcatgctgtgatatgagcattgagaaagaattgagaagctactcataagtgtgggctaggaatggaagaagtgggtctgaggatactttgaactaggccaatatatcaatatatagttaagcatgaattctgttttgtttcgtttttttttttttttttttttttagatggagtcttgctctgtcacctctgctggagtgcagtggtgcaacctcggctcactgcaacctctgcctcccgggttcaagcaattctcctgcctcagcctcccaagtagctgggattacaggcacccaccaccacgcctggctaatttttatttttggtagagacggggtttcaccatgttggccaggctggtctcgaactccatccgacctcaagtgatccacccgccttggcctcccaaagtgctgggattacaggattgagacgaatttatgggttagacaataacctagggaggagggaaaaaaggaggaaatgttgttgatgtgacaagtgggtggttgtgtgtgtttatgtgtatttttctatactgggtaataaaaatattgcctagatttataagatgacagaaggaaacccttcagaggctcttgaatttgatccttctgtaaatctatgtcctgaaagaatagctacaagagtattttataagcaaagatctccaatcccctttcttctttcagcaagttttgtcataatcatgacacaaataattcagttttaaaaaacaaagctgttctagaaaatgactgttaatggagcacttgaagcatattcggactcaacaagccaagttcaaatagtatttgtgggcatgagaacatggtttgtttttatctgcacccagacattctatccctggaaaagttttgtgccatgattttttaaaagaaatactgtctagagctttgacagtgctctctgctgataatccttaaccaattaaataggacccaccagagaccttgttcataaaagatttgcagaaaagtcacaatgtagttgaattcaaaatgaagagtgtaagataagtgagcaatttttgaataataacatattcagtaaaagataaaacatatcacctcgaaatacaatggaacaacattaaagtagatatcttgggagacatttctctcccctaacaactctttagaataaacagatttcttcagggttactttgaaagactgtaacacttaaaaggtaattgggtcaacaatcttgttttgagacaacactctagggatgcactcaacttgcctccaagcaacagcatcattttgataatttgaagaacaaaaatgttagtttgatggcctctagctgaactgacactcatagagaaagaaactagtttgtttatttctaagggatattgcatatcaagacctgaattaataccatgtgttgacacacaataactactggtttccagaataggatgtcacttttgcaagattttgtactttgtttattttcttcttaagttagggacaacagcagtaggaaataaggtctacagaaggaaatgggagccatagaattatagaatatggattctgcaggagagagcaggcaagggaggagaattagaatacattaaattcctattgtatgccaggcactctggtaggtgcttcataatttatcattgctgtattagtcttataaagcacgtattcatgtctctcatttggcagatgtgaaaaaggctcagagaagtcaagtactttctccaatgccacgtggataacgtggtagcagaaaaagagttctaatttagggctgtcaggttccaatgttattgttctttctaattgaaggctgactcaggaaaagaactagatatcatctagctcttttctaattctaatgcactgctcaattccaatgtgcatatgaatcagcacattagatcttgtgaaaatgcagtttctgattcagtaggtgtggggaggggcctaatatcctgcattttttaaagcaccctgatgatgtagatggtgttggcttggggactacacttatggtagatagtctctagtttaccctctcaggttcagatgtagaaacctaatgttcagagaaagagcctaagatccctgactggtgctgagtttgagccagtgtcaatgccaaaaggtggttttggaggtagccccctcctattctccatcattccaccaaagcagacccacataaaagtgcatgtacttgctatgcaaattcagttacaagaactccctaggcccctatttcaatgggattgctgtccctgtcttctattggaactctggagtcatcatcactgtgaacctctgtgttctgacttctacttggtgctctttctactgtaactgagttgttacatctcaaagtggcatatacaaatgagaaatgaaatgaaaccattatgattcccccacagcaggagccacaaactcaaatgtccatggtcaggcaggtaatgtaaaggaataacacggtcctcgtgggtactgacaaaactgagcgctcgtgtccatcccaagagggcagctgatacacatgtcctggtggtcaccaccatgtggaatgcaaccttaatgctgactgatcttccaggttttcggagaagttggaaatatggattattttaaatagaccatttaaaaatagtctttttagagcagctttgggtttgcagcaaaatcaagcaaaacatgaagttctcatataccactgcctccccattttctcccccgtatcaatatcccccaccacagtggttcctttgttacaaacccagaaccacatccatagtccacagtttacattagctcttattcttggtgttgtacatcctatgggttttgacaaatgcataatgacatgtactgtgactgccctaaaagtcctctgtgttccgcctattcatccctccctccatactactcctggcaaccactgatttttttatagtctccatagttttgctttcccagaatatcatatggttggaatcatagagtatgtgaccttttcagattggcttacttcagttagtaatatgcatttaaggtttctccatgtcttctcatggctcaaaagctattttctttttagcagtgaataatattttactattaataacaaataaataataaatatttatatctatttattatatagagtagctcatatttattgtatgacaatttatttattcactcatctaccaaaaaacatctcggttgcttccaagttatggcaattgtgaataaaatggttataagcatccatgtacaggtgtttatctggacacaagttttcaacccacttgggtaaataccaaggaatgtggttactggatcacatggtaagagcatatttagttttgtaagaagctgccaaattgtattctattttgcacgtaccactgtgcattctcaccagtaatgaatgagagttcctgttgctccacatcctccccaacatttgatgttgtcagtgttttgttttgattttggctattctaataggtagatagtggtatctcatcattgttttaatttgcatttccccaataacatatgatgagcagcaaattttcatatgcttacttgcaatctgtatatcttctttagtgaagtgtcttttcaagccttttgcccattttaaaatcttgctgtccattttcttattgttgcactgtaaatgttctttgtatattttggataacaatgctttatcagccaagtcttttgcacatattttctctcagcttgtagctgtcttctcactctcttgatagcatctttcacagagtagaagtcttaaattccagtgtatcaattttttttcatgtatcttgcctttggtattatatctaaaactcattgccatacccaggtcctctagattttctaggagttttattgttttgcatttttcatttaagtatatgctctattttgagttaattttgggaaatggtataagttttgtttctcaattcagttttctgcatgtgtatgtctacttggtgtagtaccatttgttgaagagattattttttttctcgatggtattgcctttgctcatttgtcaaagatcagttgactatatttatgtgggtttatttctggtctctctattttgttctattgatctatatgtctagtctgttgacaataccacagtatcttaattactgttgttttttttgtaagtcttgaagttgggtagagtcagactttcaactttatcatcgccttcaatattgtgttagctattcttggtcgtgtacttctttatatacattgtagaatcagtttgtcaatatacaagaaataacttgctggaattttgaatggaattgtattgaatctgcaggtcaagttgggaagacctggcatcttggcaatattgtgtctttctatccatgaatatggggtatctctcaatttatttagttcttctttgatttttttaaataagagttttatagtcttcttcatatagatcttgtacatatttttgttagatttatatgtaattattttatgcttttggtgataatataggcattattttgtttttaattttaaattccatttgtccattgataatatattagaaagtgactgacttctgaatactaaccttgaatgcttctatcttgctataacagcttgttagtttcaggagatttcttattgattcagattttctacataggcaatcttttcatgttatctgcaaacaaagacagttttatttatttcttcccaatctggataacttctcttttcttgtcttatcttattggactagctaggatttccagtacaacactgaaaaggaatgatgagagggcacataattttttaaattattatttttaaatatttgaaagaaaactatatagtatatacatatatattgtatatatgtatatattgtatatatattgtatatatgtaatatgtatgtatataaatacatacatatatatacataaatatgtgtgtgtgtgtgtatatacatacatacacatatatatatatatgtatttttttttttgagacagagctttgctctgttgcccaggctggagtgcagtggtgtgatcttggctcactgcaacctccgcctccccagttcaaactattctcctgccgcgtcctctcaagtagctggaattacaggtttgcgccaccatgcctggcacatttttatatttttagtagagacagggtttcaccatgttacccaggctgattttaagctcctgacctcaagtgatccacccaccttggcctcccaaagtgctgggattacaggcgtgagccactgtggctagccaaaaactcaaatatttttaaatgctgggctagctagacaaaatacatatggagatatatatttagctagagagctagcagattgtgacctctgccccacatccttgtgtggaaaaactatgcactttcagattattggaatcaacttcttttgtttttttttgagacagtgtctcactctgtcacctaagctggggtgcagtggcacaatcttggctcactgcaacctccacctcctgggttcaagtgattctggtgcctcagcctcctgagtagttgggattacagacacatgccaccatgcctggctaatgttttgtatttttagtagagatgaggtttcaccatattggccaggctggttgtgaactctcgccctcaagtgatctgcccacctcggcctctcgaagtgctaggattacaggtgtgagccaccgggcctggctggaatcaacttttttaaccaaaactattttagacatgatctgcataatgattagctactttatattcaggtatttacgatactaaaatgactaagagaatgagtcttataaaggccctattctggtctacatacccttccaatagctaactagtgataggactgagtgtgaatgaatctttacaactggagttgccagaaactagagatattataataaattacacagacaactcagtctcaatacatgatgggagaaagagagggatatatatgaggccctaatcaagggttaagtcttggacatggttataaaatcaaccacctctttctttcttcctttctctctttgacagcaaaatacacataacagaacatttaccatcttaaccattattattactaaattaccatcttagccatcattaaccactttcatcttctctaactaaaactttgtacctgttaaacaactctccgttttttcttctcctcagccgctgataaccactcatctactttctgtttctatcagtttgactcttctaggtacctcatctcactggaatcaaaccatgatttggtttgtttccaaaccaaactataagatattaaaattaattcagaaaggctagttcagaaggctaaacttttctaccactgcttagtatctcagtaaacaaccgtgctcaaattttcatttgaggattggttcctctgagaatatctaggatcctccagggtgttggagggatttgaacaattctcaatcaattttggatgataacatatgtatgtatttctgcttgtcctattcttcatattcatattcagggacttccttcccttccattttgtatatctgccatagaatttcaacttgtgtaacttggcttcaaaatgttcctctgactaggggattatttggttggcaatggactgttaatcaaattaaatagtagcagctggcagttcctttccaatgtggttagatgagacacctgggtaaggtatgcccacttaattatttacaaaatgaaccaaatccagagaaagaagtaggtgttatcatggtttctgcatcttattttaactgataacttatcttcaagtcatcttttaatgtgaaggtatcaaataattcaagcaaatgttacaaaatatatgttttaaaagtattactctaggctgggcgcagtagcttacgcctgtaatcctagcactttgggaggtcaaggcgggcggatcacctgaggtcaggagtttgagaccagcctggcgaacatggtgaaaccctttctctactaaaaatacaaaattagccagacgtggtggcactcacctgtaatcccagctacttggaggctgaggcaggagaatcgcttgaacctgggaggcagaggttgcagtgagcctagattgcgccattgcactccagcctgggcaaaaagagcaaaattccatctcaaaaaaaattaaaaaattaaaaaaagttactctataagtaacagtccatattaaatggacttaagttctacagctgccattaaaaatatggattggatcctttgtggctcagaatatcagaattatgaattcaattaatttattcaccatttctataattctgcatacaaattaaatgtcaggaaacctagtaagttagtaagaacatagagtgttgaacacattttgtttaagaatatagaaacttgggtttataatttatgtatgatctgcatttatgcataattctatgactatactggagattatctgagtattatatctgacttagaatttgagaaccttatgatttactgctgttgccgaagaaaagaaatgaaacaccagactcttgaaggacagaattaactgtagtgtgtgcacccttggtagggtagcacccttggtaggataagcatgatcacaggcagagagaaatgatatgttcttgacactaactagtcatgtcgcctcctgagttatgaggcacttttaagtgtcagcttacctataaaatacaggagttagatttctgtagctgatctcaaaggtgtattctagttctaaattctgatcctatgaaccatttacggtttcacatttatagttagctttaatcaaccttgatatattatgaaaataataggtaggtatgattttttaaaaattctagtagagaaaggcttatggaattatcggtgatcttcttatacctccacctccactccctataagaaatcactattgacttctcctggtgataacctccgtattctaaaagggaagtggtacttatacctcttttttttgattaattgagtgtagataacgaggattttcctcacactccccattgcagttaaatcactgtagtgagagagatcctttcttgaatacctataaccatttacacctttgtttcttgttttatttcctactgacagtgtctcctgattttctattttgaaagatgagaatattcatcattttaaacgcagcctgtttacatttgaattatgttagttactatctgattattttcttcaaaggaaagagattaacatttagatgttttagatggtattcctgaatagaataagtgttcctttgaaaactttatcgcaattaattcaatgttcattatatgaactatttataaaacaatctcagaaggttgtccttggcttttgttaagtcattctttaggtttcgaacttgcaaaactgcagtctttgatcttatcttcgatttacctgcaagtgtacaattttttttaatctcaaatacgtattgcaagggaaagcaaataataacaaaataaggctcttttactaagcactgttgacagtatcaagaattgtgaagggtcagaggtttcaccctacttgccagctaacaagttagcttgccatagcttcatgaaaacaggcagaaagcatgagacacgtgggtcagagacaaatgacattattagtcacagcacagtaaacaacaggactttgatgttctgatccctactagggtcccagtgggggtacagagggggcaggttcaggtggatactgcaaacgttaagtttgcgtgcatctcagctgagggacctcatgcttaggaaaccccagtcttttataagggttgcaagcaaacctgcctaacctttgcctccaagggagacattatttttattgtactagacagcaacaaacatgccccttgcccaggagggaaaccccttggaatctcaatcttccaagggttttttgctatagaaacattcttgaaaagatagtcctgaacaaaagccagcaccatgcatgcctgaaggaattgcagctactatgtataaaattatctaaacccaggatgctattaccttcctcactggcttttggtagaattaaatgataatacatcaaagtgcttactattgttaggtgttcaatcaatgctggctactcttatacaacagcacatactcagatgaaagaactttaatacttgagtttcccgcctccatcataaaaataatatatgcttctttttttccttttaaatagactttattttttagagcagttttaagttcacagcaaaattgggaggaaggtacaaagatttccctgatattccctgccctcacacatacacagtctttcttccacaccacccacattccccagcagagttgtacatgttacagctggtacacctgacattgatacatcattattacccagagtccatagttcacgacagggttcactcagtgttgcatattctatgggtttggagaaatgataaaatgacatccaccatttgcagtattatagagaacagtttcactgccctaaaagtagtctgtgctttgctgattcattcctccctccccacaactgctggcagcctctgatctttatactgtcttcatagtttttccctgtctggtgtcatacagttggaatcttatggtatggatgcttcttttttaaaaacgtacaaatattattaagataaagtcacccacaaccttcctacaaagtagtacctttaactttttgattaatttcctaatgatacctttctaggcatctattttttttaaattccttttgtcctttagagagtttcatttgtcaccagtttaataacctccacaaaaactctttaaattctttctttctttttttttgagatggtctcactttgtcatccaggctggagcggagtggcacgatctcagctcactgcagcttcaacctcccaggctcaagtaatctcaccacctcagcttctgcggtggctgaaactacaggcatgagccaccacatccagttaattttgcgtattttttgtagagaccaggtctctacaaaattatgttattgcccaggctggtctcaaacccctgggctcaagtgatcctcctgtctcggcctcccaaagtgctgggattataggcaagagcccctgtgcctggcctaaccatgctctacgtatcagtcaggatagggtagtttatgctgtgtcacaacagaaaggcttattttggccgggcgcagtagctcatgcctgtaatcccagcactttgggaggccgaggcgggcggatcatgaggtcaggagatcaagaccgtcctggctaacacatgaaaccccgtctctactgaaaatacaaaaaaatcagccaggtgtggtggtgggcacctgtagtcccagctacttgggaggctgaggcgggagaatggtgtgaacccaggaggtggagcttgcagtgagctgagattgcaccactgcattccattctgggcaacagagggagactctgtctcaaaaaaataataataataaatttaaaaaaaagggcttatttcttgttcacactacacgtgcatcctgcactgtcctggggttctcttcattacggtccctcaaggacaaccaccatcatgttgtcaggtttgaaaaaaaatgctcaaaactcatgaccggaacgtcacatggctggaccagatcacaagaggcaaaaaagaacaatcctaccatgtgccaggtaggaagagctggaaatgtttggtgaacaggattcatgacaaccagtttacactgtggctagcagaaataagaatcaacctacaattagtctttgttgcccatttaaatcagtgaaataatttttttaagttccagggattgatcaaagcaaataaagagcatgaaactaccaaaatctttactacataccgtggttaacattttcctctttgcctattgtgctaaaaacacaaagcacttgagtgatgtttatctgaagtctcaggagtattaatcaagaaattttaatattgctaatatcaaaaatcagtttctttttctaagtgggggtgttaaattgagctaaaagaatgctcaaactactgcccactacactcctaggctattctgtaatagtaatgttatgagatgaaaggtgtaagcagaaaacaggagagaatagaatcaggtggcaagtacttatacctctttccatatacatacttattatatatgtatacatatacatatatacttttctctttatatatatctacatgtatctatagatattgtcacttgatatatattgtcactgaaatttttatccatttagagagaaagagaatacaaaagctgataataaaaatctaagtgacaatatgttcgttctcagaatcacttagaaaagttgcttaatccatatatgtgcttaggacaatctaatttcaccttagcagtaggcaagtgatagaacatttttttataagatcaaaggaaaacaacaacaacaacaaaaagcaacttgccagaatggggaagaaaattctgcaactagatcccttaccttatgctatgtaatagccatgcaatctatacaatgatacaaccaggacagatgtgaggcaaaccattaactactgtctggcataaaaagttaaatcaagtccagctgcggtggctcacgcccgtaatcccagcactttgggaggccgaggcaggtggatcacaaggtctggagtttgaggccagcctgaccaacatggtgaaaccccatctctactaaaaatacaaaaattagccgggtgtggtggcgggtgcctgtagtcccagctacacgggaggctgaggcaggagaatggtgtgaacccatgaggcggggcttgcggtgagccgagatcgcaccactgcactccagcctgggcgacagagtgagactccgtctcaaaacaaaaaaaaaaaaaaaaaaagttaaaccatgattacattttctaaggctcccttcccaagttactttcttgcttttcccattttagtgaaccgcttccaaattcaatgtatttctgattggctcacaattctctttcccagctgtgttattaatatttcaccagtttcctacatgtatttcccacaacccccgtgaacactggtatcacatcatcaaagaagttccctccgtatacaacatcactagggacacacaaacaattcttttcaaaagaagacacacctatattatttaaataatattacagtcaaaactgaattttacgaatgtatttacaaagtaattccattacttaagaaatatagggaaattatttctctgaggaagaatgcgacttaaaaagaaaacatcttttagaaacatatgtggattgcttttgtcagctcaactcccaatttgctgggaagtgacaggccatgaatacttcattctccttttcctggtgattttgtaaatgactgccttatttattaatggaaagcaaatatacaaaagtatcatcttaatgtaaccgcaagtttaaatctgatttttttctttttccaaggcccagcaccaggtttaagcaggttagcatacctcagataaccctggaggaagattccttctctgagagtgtgaagctgtagggctgccattagtagttgctaattccaggtttcaagtcctcacttatggagaatctgacttagtgggacagagggcatttttaaagaaagaggctccccaaacaattctgatacacagcaaggtcccagaacaagtgacttacactgttcttaaaatgatagctttctcccctaaattagaaagaacataagatgagcatagaaaaaacagctgaaattctaaagtttgaatatcgtacatgtacatttattaatgactgttgattaaaaagatgattttgaaggaaaaatgctgctgagaaagcacgcgcacaacttctgtagagttgtcatacagagagttaatcagaagttagggaaacaaaccaagctaaacaacccatttcttgacttctaattgccatacccacctctgcacaaggaattagtaaaattacagtacagatcaagttccccaaatcatttttaaaagaaacgatcaatactaaatattagcagctaaaacatcattgattcttgtggctttagaactttcacacactgagagctccataagaggaaaaaagcaaagaaaatcaacacaattgctcatcagaagatagctgtattttctagtatgtacaaaacaaagagtatctcatgttctatcatcttccttcctcaagtttttagggaatattaagtaaaaccaataatcagtgctaagacatgcatcactgtgacataatgaaattcaatcaggactgatcatgctgagactctgctgtttttttctttgggtctaaaaaacttgtatactctattttaagcatccaaatatgatgattccttttgggtttaatatatcactgtggaaataaatctcaaagtagcaattttttgcaacactgatcagaaatccaagtgtcacttaaaacttaaatatatacaaaatacagccacatacatattcatcttcagataatataagaaaggttaaataaaaatagataatacaatttcagatatagaaagtgccaattcaacataaatttatttttgtgtttattttacaaaaagactttagaacacatgaggaacactagatgatgagagtgagcagccttttcagcctttgtttctttcttctttaaatacagatgttgacagtaaagatggattagatgcagtccactttttcctcagttggctgatttttttcggaattataaaccatgaaactaaactgagtaaatgttgaaagtttattgcaagcagcacctggggccaaaaatgagaaagaagtttggtgaactataggatgcacatatttataaccaatacagatactgcttatttgactagacactggctactgtataccttatgtctaagccacatggaaatacactagtgtcatcctcctcagaactgagcagtgaacagtccatgaaaggaatgaggtagctggtaaactatctctttgaacttcagaaaactggctggtttttgttgttgttgttgatctatacacatgctgtcactgctacgattatttaactgttcttacgtgtttttcttagaaaaaactattcaggcacatctcccacattttatttctctagccactagaacattctcatcattcattcataaccccataccccaccattgctccctattcttctactctcacaggaagagtcaagagtaatttgtcaagatgctttgtctaatcaagttcatcttctcatgctcaaacacctgggggagggtcctctttggtcattaaatagaagaaactagtcacctgtaaattcatccacaattatataattatcatttttttcattctgttaaatccaactttgagctttctaataaggtttatttcttaagagggaatcaatagaactgccttatttgatacataaagcttttccccttcataatttttattgacttttgtgtcttagtgcttaaaaaagaataaagcattcctcaaacaagtttttcaaatatagaactgtgggaagtaaaagatcaaagaacaataataagcagtccaacctaataagtcatattgatcagtaagctgtgtatcttccccatctgaaaattcactaatgagaatcagcagtggctgatcttaaaatgctttgaaactgtgataggctcatatggaaagtaaatgaagtgaaagacaagcctcaaacagtgcaaaaataattctgctaacctcttcggtttactaattagtaatacattttgttctttggagccccgagaagatctaaatggctgaggcatttaaataatgaatagaaaagaaatagggaagataatttatccttgtctatttttaattagtataaacatttgactagattagcctatgtcaacgtgtactggagctgaagctaaacttcatttaagacacatgtgaaagataagaactactagtcagagactgggtcataactaccagcagtcaatccaaagaggcttttaggtatatttttaacgctgtgggtcttgagatcatcaatgaacatttactcaatgcccacttaaggagtctctttttctattgaatatagtgtattgtacaaaacaatatttaaaaagtgtatgttttagaaatatttggaagttcacacaaatacaaaatccaaacacaacttaccgtaacttccagtcacattggcacatataacagccccaaagaattctggaaaatgcttctggattcttgaaatcactttttggcaagctatggttggatcttctcctcttctcatgtattctacagcttggtagctgattgaaacagaggtgaaaccttagtgtctcagaataaatactaactccaaattgggttacttgaagttagaaattaaaaccaccaaaattgccacatgtgatagaatacacataaatgaacaagagtcggttacttctgttaaagcatccacaaagcaagtccactttgatacagagtctatcttttcaactaatccacccatgaatttcagatgtggaatattatttttggctttggctgaataactgtcagtaatgataccgacagtcaaatgtaatggccagaactcaaaaagaatacagattttcaatgagaaaaacagctacaatcaaaggggaaagtagtgtgcatgggcacaacatctagctagggtggttaaaggtacacgatgactgcacttcctacttttaccatcaattatcacagctcctttactcagtagctttacatcaattactaaatagatcataagtattctcatctgggaagcagggtgagaaatactactttatttcacaggactatgattacttaacttgaatgattatcattatcaaaatgataggcaacaagtttgtatgcagtttctaagaagctcttgtgcacagaaattcaggttacacaatacaaaaattatgttttctttcttttattttcttgagacacagtctcattcttgttgcccacactggagtgcagtggcgcgatcttggttcactgcaacctctgtctcccaggttcaagcgattctcctaccacagcctcccgagtagctgggactatagacttgtgccaccatgcccagctaaattttttgtatttttagtagaaacggtcaggagttcgagaccatgttggccaggctggtctcaaactcctgacctcaggtgatccacctgcctcagtctcccaaaatgctaggattacagtcgtgagccactgcacccagcctcaaaaattattttctatcttaaaagaaaaaaatatcttctccaaaggtctctaaaattcacaaactaagaagtcataccttggcaggaagcgcatcaatatatcaccattcccagtggctgcggctgcccctgcagtatcgtcagcataggctccagctccaggtattggtgagtctcctacacggctttgagagggtattaacaatttacggcaggaaatcgagtgtaaaacacattaagtcataagctgttccaaataagggatagttccacttagcctctgataccgttttaagtaaattcttcatcggaacaaagacagaacaggtcttcattagttttttaactaaggttttcacaaacctgcattaattatgtaagaatttgttatcagacgtggagtgtacaacagctgaactcacagaaacagagactaaaatggtggttactggaggctggggggagggggacctggcgagatgcgggtcaaaggacacacaattccagttaggcaggagggtaagttccagaggcctactgcggatcatgctgactaaggttaataacaatagagtgcacatttgaaaactgcgaagtagattttttttttttgagacaggagtcttgctctgtcacccagctggagtgcaatggcattgatcttggctcactgcaacctccgcctcctgggttcaagcgattctccctgcctcagcctcctgagtagctgggactacagacacgaaccaccaagctcagctaattttttgtatttttttttttttcagtagagactgggtttcaccatgttggccaggctggtctcgaactcctgacctcaggtgatctgcctgccttggcctcccaaagagctgggattacaggcgtgagccactgcacccagctgaaaactgctaagtagattttaagtgttctcaccataataaaataggtctgtgagataataagttaaatagcttgatttagccattctacaacatatacatatatcaaagtatcatgttgtacaccacaaatacacataattttcattgtcattaaaattaattttttaaaagaacttgttatcagccaggtatataccaggatggcacagatttacagtgactattctattattaccatcctttatcatctaatttccagatgattgcaacatgttcaaaattggtttccctcatctataatctatttccgcttcctatgtaatgtgccaaacttttaccagatttttttctagtaagaaatgtttaatgcttttctatttcaaaattaaatccagaatgccttcaactgacttaagactccttaaatctggccccagtcttcccttgtagtcttatcttccaataccacttcccctaccccaaaatacacacacacccccacaccccttcttccctagccagtgggagccctgaatacacacacacacacccacaccagtgggagccctgagcgtgcacgcacacgcacacatacacacacacaccccttctttccaagccagtagttctgcgtgcacgcacacacacacacacacacacaccccttctttccaagccagtgggagttctgaacacatgcacacatacacacaccccagtgggagccctgaacacacacacacatatacacacacaactttcctagccagtaggagcgctgaacctcaactaccatgactcagggctgagctccaagcatcactttactggtgttcctaactaccccagcttaaagagatcacctctgccacccctaaaccctatagcactggctgtgactccctctcctgtggcactcagcagagagtactgcattttctttcacactcattcatcgcagctgtgagactagggctgtgctttgcaacccccatagcacccggcatatattgctctgcattcagtgtatatttgagagctctgttcttttggaaacactaacccatgtattttgaattttataccatttgtagatgtaccagcagcaatatgtcctgtcttatggattacaaccatgcctagaagttaaaaaaaaaaaatcactgtaggtgtataaagtttacctcaaatataaccaaataattgagcaactggtaataactgctgtgctctgaatgtttgtgttcccccaaattcatgtcaacatcctattccacaaggtgatggtatcaagaggtgaggcctttgggagctcattaggtcatgaggacagagcccccatgaatggaattcatcccttataaatgaggccccagagagcttcctcgccccttccaccacgtgacgacacagcaagaagacgccatccatgagccaggaaaacaagctgtctccaaactctgaacctgccagcgccttgaccttgaacttcccagcctccgtaactgtgagaaataaatttctgttgtttataagccatccagtctgggtattttgttaactgccactataacaggcaattaacattattaattattattaacaggtggggcctttaagaggcgattaggctaaaagggcttaatgccattatcgcagggagtgggttcctgatataaaggatgagttctacccgatttcctgtctcattctcttgacttccaccttgggatggcccttgccagatgccagtgccctgttcttgaacttctcaggctccagaactgtgaggcaaataaacttttgtttataaattacccagtctgtggtagtctgttataacagcgaaaaacaaactaagacatagactaatgtaaattttcaacattgtaacttggaaaaagttatttaaggtcactaaaatacagcaacataaaactgccaaaaaatgaaatgtcaaataaagatttaaaaatccgcaagtgaatagtcattgggttttaggtgtcttgtataaataatttgccaaattttatacagatcctaagacaagatggatctatctatagagaggcacacttaattggcagttaaaacaatcaaaatcaacttctggtagaagaatagggaagagctacaggaagataattaactaaactttatccataaaaactgcacaaaaggcaaattaccaatagtgtcatgaccacgatcatcttctgtttctttatggataggaatatcctgctttaagataccaggtggtttgtagggtccgcagtattttgagggatctggtataacattctgtaaacaagatttaagttttatttcttacaaagggtatttttagaaattgccaagaaattatgtacaatcgctaaacactagcaagaaaccaaaaaaagacatctggtaacttaaagataagaattaaaagctaagaaatcactaagtcttatataaaaacaaataagataaataattttactgaatatccattctagtctaagaattaaataatacaggtgaggtatctatattgcatgacacaggtccctaatttctctctttatatatatctaaaattctcaacacaatagtaaaattttttaaaattagatattaatccttaaagaaattagatacacactggacctttaaatttcagaaatttgttccttggccaaagaattctgagacttaaagtaaaatatgttttaaaagcttttattgtttcttcaaagctaggtttatgtgaatatattctaagttgtgctttaagattcctttataaatctaaagggctcaagaatataatgcaaactcataaatttaggttgtgtatgtagactggtattaaagcaagaaacctattcctattcctcatgtcttacacatcagtgcgctaggtgcctcccctaacttcgttttatgattagcctctttcaagtgctaacccaagggacttctgacttgatggctactcgaaagtaattaggacttagggaagaaatagatgagagactaagatatcccacagaaggaccctgtacggcaaaggcaaactgatttatgccaaaagtctcattaaagaaaaattattccactggtaacatactagacatgtaatattacatgtcctcaagtcaagaacaagatactggatacactgcacgtaaaatctaagaaatattttagactcatagtttccaaactgattttttagacttagttagaaagaaatacaagcagagcagccctgattgaggcagccacctccacatggcagaaacttcagtttgaaaactattgtgagagaccagtagctctccatgctggatatgcacccaatgcagctagaggtgtttcaggaacatccatacctggagagtcaactaaaaccactagttctaatgtacagccaggatgctaaccagtaccctggacaacaggcaggcaacactgagcagaaaggatgtcactgaatattttcaattaacttatttttttaaattaaatgtgtgcataccctccaataatttggctggcaattccgagcaagccaatctgaatgaagagcttgagaagcagtggtagataagtcttcattgataaaccccatactttgagcaaatgtggtggctggagattggaaaaaaggaaagtataaattattcaagtattgtcttttcaacaaaaatatatgtactagagacattctgggtcagcagcatcttaagtgagctacacaaagactttcaaaggaatattcacacatgaacagttttaagagactcaatttttagaccttcgatttccttatgcctttcctaaaacagatccacttaaaacctttggggcatgcattataagagttctcgtcccggccaggcgcggtggctcacacctgtaatcccagcactttgggaggctgaggcgggtggatcacgaagtcaagagattgagaccatcctggccaacatggtgaaaccccgtctctactaaaaatataaaaattagctgggcatggtggcacgtgcctgtaatcccagctacttggaaggctgaggtaggagaatcacttgaacccaggaggcagaggttgtcgggagctgagatcgcgccattgcactccagcctgggtgacaagagcgaaactccgtctcaaaacttccattgccttcttcttagagatgaagaagtaaagagatttaaaagttacttatccagttcaatagatgttaagtaaaacagctggaatttgaacttagatctggttttatccatgattttgtactatttttcagtgaaaactatagtcaaaagactagaaaaaatttcagtgtagttaaaaaaatacctgactctcctactaaaagtgtgtgtgttgtatgttccagtactttccgtgccacaccaatagcatttttaattcgtctgagatctcctactgctcctacatccatagtagtgctgcaagaaaatagaatgcagttaggaattaaggagttttcagaggttcatagattaaaaacattgcttttctccaatcaatagtgttttgcggttaaactccaccatcttaacacagaagtgacagcacatccacgaagttcatatagattcccacaatcagacaaaattaaggaaaaaaaatagaaaatcaacttgccatgtaccacaacagcactaaaattctcagtttctccaagctaattttaaatatggcttttgaaaggggcctgaaggcttcaggtcaggcaaaccacagcatttgtggacagcagataaatgattgtttataaggtcagagacatagttttttagcttggcattctcccagttctaagggactacctatctctccatgtgatatttctattactctgatttttttttttcagttgagagggaaactgtgtttagaaaggtcaagtataataagctaggggttttgatctgtgtcaaaactcatgcattctttcatcttgctctcagaagaccacaactctaaatgtaactcaacataataaataggacctgaacggtgttcttacccatccatgatcatggcatctagtgtggtttctccaagttcatcaggacttcctccaaagcctacagagccgtcacactgctctctctcacacatggcacagccgctctccactgcatccagggcagagcctccagatgctaatgccctccacgctgttaatcaaatcccaataatgcttgtttatatatatatttttttttcaatgccaaatgcaacaaaccaactccaatttaacaactttttcacatttactgagttaagctgattttttaacacattagtttatcaagtgttacaaaggagtcagtgaagagtcaaaattatttaactagttatcagaagaactcaaaaaactggctattggtgcaagctgaaggtttttttttttttcacttactaatatctatctcttctgtgtgcgagaaacgaaatcagtatcccctcctttattttaaaaggtacaatcgaaaccactaaaaggcagttaaataaaaaatccactaaaccgcagccttcttcacacatttcttctgcatcattagattaaaatatgcataattgatatgtgtattgaggtaacacctatcccaggaagtcttaataatactgaacagcaaacaattacaacgtggacttcatatggattagttcattgagtcttcataacagcttctgtggtaggtactgtacaatcacgaccctcattttaaagaaaagtaaacagagccacaggtcaggcagttagtttaaggtcacacagctggtaagtagcagagccaggatcccatacatttgggggtgtggggggaagggtctttgatggacaatttcttttctggtaacaacagaattccttgaagagtgggtgctctggttggtaaacactacagcacctacaggcttgaaagtgtatttacgcaagttccctctttcaatacaggcaacttaaacacagaactgtcccccgcccaggctgatgcaatttcttttcgtctcattatggctgggaatatctttctcacagcctgcttcttcattttctctgaatcgtatgcactgccaccaaattctggagccaattctgccctagaaagttaatacgttagcaacctcagatggaggaggaggggtctgaaaatgactcttctggtcattaagcaaatgaaagaaacaagcatagtacaatgcgaaaatgccaagataatggtacgtaaaggctattaacaaggtgtagaaggcaggaacctaactcattctggacacgagggcagttaagtcagggaacgcttcctggaagaggtgataccttagcttagtggttctcaaccctgtctgcaaatcgaaatcacctagggagctttttaaagaaaaacagtggccctgattccagcagttagatcacagtcacaggaggtgggccccggcaggatgatttttgagaagctccccagatagtgtgaatgtacagcaaaggttggaaccttgaattctaagtggcaggtaaagtatgacaacacgtggcaaaaaaagtaaatgggaaaagagtaggctatggctgggacactattagtcgtctacaaaattgcaaagaagtgaaggattagaaacgagaggtggagacgtacacagcccgtgaaaagactgtcaggcagaaaagcgtagctgctacttgattaaagcacaaaggccataactatggtcagcagcagggtggaaaatacattgcgctgggggctgcatgaagggaggacctaaaatgcaacagcggtaggtggggaggatgcagtaaaggccacttgcaagagactgagcggcgctggagactcgggaagacctagagggcgggaccgcgaggcccggcccagcccggcgctcttccgtccgccctgccgggtgactgcagcggggcgggctagtcatccccacccgcaagctctcgcggcgcagccgcccgcccaggccgccaacccgcacctgcttcggttgcattcttaaagggccaagtgttgacgaccaggggcagagggctggagcagcgcactagggcctggcagagcagaaacggcacgagaagcacaggcaagttcgacttccgcgccatccctgaccaccgaagagaccagcgcgagaaaagtcccggcagccagcgatcgccgaacaattaatccccagtgccccgcccgcctggcgcccacgcccgctctctcgggggttcgctcaggcgtccctcaactctcgcgagacgaggcgtccctgggcccgcgggagagttgtgtcacggggcactgagctgttccctgcgctaaggtgcttcttcctaagtgctgttcagatttttaaaatagccagacaagttgctgcttttcctgtggttaaaatagatttagcttgatattgggaatttaatacaaaattattcaactctgggttgcagggccccaggaactttagccgattgctgtgtactatggatttggttcttttactgtctttttaatttaaagttgaagttgaaaagtttgtcaaactcagtatattcttggggatcccaggcctcggaggtctgcaatagttatgagtgtaggtgaagcgtgtttgcttaggaccggattgattttagattttttttccattcatagcgtccgtcattttcgcaccacagctttttgtagcacttcctctcattataaatccctgagctggaagaaaaacagaaacggcctatgtaccctctacctagcacactgaagtgcagcttcctgcacctccagggcaagacggctacctccattcctttttaaatgtatttttaccttcctgcctggcactattaagtgctaaataaatgaataagaggaggaatggggattttacgtgcttggtggaggctgctcagttttgttgctgggcagacgtgcgaacatgaactaataatccctttgggtgtctggaatgcctgcccaggttgccaaggcaagacacataatcacataatttttaaaagcatctataaatctatacaaactttaaaaatatgaactaggctgggcacgatggctcacgcctgtaatcccaacactttgggatgctgaggtgggtggatcacgaggtcaggagttcgagaccagcctggccaacatagtgaaacccgtctctactaaaaatacaaaaattagccgggcgtggtggtgcatgcctgtagtcccaactacttgggaggctgaggcagaattgcttgaagccgggaggtggagattgtggtgagccgagatcgcaccacttcactccagcctggacaacagagtgagattctgtctcaaaaataaataaataaataaatgtaaaaatataaactaggtaggagttgtgagacttacaaaaccttcaaggctcttattgattgctaggaaattaaatacataatttaaagaacataagatagcccagaagtatcattatcccgttggggaagtgttaattaaaagatataataaagacaaattttctaagttcctttcatggggtttggaagaggaacaagtcatctgtgctggagtaatcataacccaatggcaggtgaaactggaaacttgggtgaaacagggtaagaaagccagaaaaacatacattgtcctctgagtaaattttccttagctcctgggctgagtatttttatgcagccttaaggaattaggacatgcctttagcaaaaattgtaaaatacaatacatggaaaattggtcttagtaccccactgatctctctagcctcttcctgttttttaaggtatttgtgtttcttctggtggaaagagcctgatctgttacctcctactatgtctatttctccaaattctttcttcttaaataaaaattcctgtcagagaaacagctaaattacactatagtgggaatggctgatagaaggtctcaatatatcaacttttccatggatatttgtatgtatgtatgtatgtatgtatttattttttgagatggagtcttgctctatcgcccaggctggagttcactggtgtaatctcagctcactgcaacctccacctcctgcattcaagcgattctcttgccccagcctcctgagtagctgggattgctactgcctactaccatgcccggctaatttttgtattttaagtagagacaggttttgccattttggccaggttggtcttgaactcctgacacaggtgatccacccaccgcccccacccccccgacctcccaaaatgctgggattacaggtgtgagccaccgtgcccagccggatatttgtatttaaataactaatatgcaatccctatagaatctacccgattcagtgtcttcttagtggctactaaaatacctactggatccactgtccagtttgcctaaattgtagctgtttcttaagttaaattcgtctggatatttggttccttctggagtagttttcctttgactaacacttgaagaataattttcattttagttctagaagtaaccttctgttactctcacttaggtgctcttttgggcctaaatataattagatccttcgccgttgttttgaggtaaatctaaacgaaaaggaacacctgttaacaggtagtgatgccgcaggaaagtgctgggaagggaatgctgggaagggaagggcgtggtccctttaaatgataaggaaggggggcgggaagtgctgggtagaggagggcgtggtccccagctagggcttcatccctgggcctgggcctacctaggtgaagacaggcatttttgttttcctgcccggatgttgcatttcccaagaccaccctggcctgccatgccctcatcctgtgcctttaaaaacccccgagaccctggcaggcagacgcacaagcagctggacattgagaggagcatataggcagagaatacaggggctgctggatgtcgaaaggaacgcaccagcataggagcacaccggcatgctggcaggccattgaccagcggaagaatgcagagtttgtcgcgggaggtcagagaagagtcaggccgccatacctgactccaggagaaaaccgtctcccttctggttcccccgtctgccgagagctacttccactcaataaaactttccactcattcttcaagcccacgtgtgatccaattcttcccgtacaccaaggtaagaacccgggatacagaaagccctctgtctttgcgataaggcaggggtctaattgagctaacacaagccgcctacagacggttaaactaaaagagcaccctgtaacacatgcccactggggcttcagctgtaaacattcacacctagacactgctgtggggtcagagcctcacaatctgcccgtctgtatgcccctatagaggtttgagcagcaggacactgaagaagcgagccacacccccatcacacgccctgcaagggcgacaagggaacttttcctgtttcagtagtagaccgtaaaataaatgatcctcagtttttccagcatcctctccaatttttcattcttttaaatcattatacacagggcagagatatttagtgttactgataaatcaaaggaactatttgtaaaagtatttttatttaaatttagaatgcattacacaattttgtttggcaaaatgtttctgttcctaagtagagcttacttataactagcaatacttcaggaggattttccagacttagattttaaaacttagggtgtggccaggcctagtggctcatgtccataatcctggcactttgggaggctgaggtgggtggatggcttgagcccaagagtttgagaccagcctgggcaacatagcgagattcctgtctctattaaaaaaaaaattaaaaaaaggtgactgtgtatcagctgtggttaactcatgtaagcttcctaagccatgcttttctcatctataaaatggagataataatagtattctttcttattttacaaagctttgtgaatgaggtaggagatgtgggagaatggtgtaataccaggcaaattaaataaaattctcttattctaatttgccattcccaagtacctataattgatgtcaaggaggcagtccagaaacatacaaggcagtaaaaagaaatcaatttgatcaatttgagacacagaaatttccacaggaagaataaagagttggcccaatacctataatgcatttgaaagtaatcacttagaatttccttgaatatattaaatgagaattaaaaataatgtttttagtttacttggagctgcctgaaatttggtttgaatgcttataaagatggtgcatggcaggactgtgagatttctggatgtcttaaaaacaacacccttaagtcttaacaaggggaaagcctcaaatggaatcttaagtgatgttgcaaatagagcctttgtgtgtttgtgtttgtgtatgtgtgtgtgttggaggtgggtggaggagtttcagaccgctgcaggctctcttatttcctctaaacttcatggctttcaatttatcagtctcagaaggatgaagagttgagtccctcctgatagcatttgaagctgtggttccacagaggatttaatgctgtagttgcagggagtctaggtatttcaattctgaggcttaaaaaactaagccatcccctccggcttttgcactgatgctgtgaaatccatttgagaaacatgtccatgttttgctacttgttcaaagctgtaagcctgacttggcattgaaatgataatttctttttcaaaactccccactgaactattacctaggttatctaaatataggctatttacttgattggcatttgctcctgtcagtttcataaactgtaagtaatgatttttgctgatgttagagcattgtggtactgtgtttctaatttaaatcaatgtctacattaatctgggaacatttgatgttactacctgattgtacattctggatgtaattagagtcattatacagaaataagtgtcatcctcttattctctaaatgagaaaagagagcattcttctcttctgaaataatttttctgggtcatgcccccaaaaccatttgtcaaatcaatagcagattctaatcacaaacttttttgactttttaacctttaaaagtcatcttagtgacttataaagaccaagattgtgcagtagaatgtgggcctattaagttatttcttatcaaaataaattatgtacaacatattttcaatgtgtaattgtaatactgggccactgctgtgatatagttttcataacaaggacatagtagactattaaacatggtggatcttgctttttgtgacagttgtttataacattatgatgtcatcataaatgtgatccattacaatagtaaagccttagggcaacagagtagatgtcaggatgtcttcctaccacttaaaaaatgactttgacattgttaaggtagtgtgacagatgatttcaataaagaaattcaacaataaaagcaaacttctaaactaacagtgacttacaggaagtacattatgcatttaaaatgatatctacttgtcgatcatgacaatgagtattagaaaactatccaaataatgaacacatgtatcctgtgtgtagctacacaaatagtctgttaattctcaatcattcatataaaaatatgaaaggaaagattttcacataacatagcttatttttttcattttttagaaacacttttgtgtccttcaaatatctctgaaatactctagctcttgttgaaaatcaccagcctcttaacattttgatatgtatctgtttggtgaaaaatcttggtattatacacactgttgtagaacctgcttttttatttaatatctctttgacctctgcatatcattaaaatttatgctttttaaaaaccttcattgtgcaatgtaaatacagtaaaggacataaaatgtaaataaatagattaaataattttgtagaaaatgaacagctatgtaatcaccacttatataaacaaacagaatattgtcagtaccccagaaaaccgctaaggacctctataacatgttctctgaagatttaaaaaaattttatttaattttttatttttatagatacggggtataagtgtagttgtgttatatgtatatattgagtaacggtgacgtctgggcttttagtgtacccatcacccaaacaggatacattgcacccaaaaggtagtatttcattcctcaccccctccttccctcctaccttttggagtcttctgttattccactctaaatgtctgtgtgtactcattgtttagctcccacttacgaatgaaaacatccagttttttactttctgtttctgagttatttcactaaggataatggccttcggttccattaacattgctgcaaacgacatgatttcattcatttttatggatgagtagtattccatggtgtgtgtgtgtatatatacatatatcacatttttaatccagttgtttgctgatggacatttaggttgattccatgactttgctattgtgaatagtgttgtgataaacatttgagtgcaggtgtctttttgataaaatgctttctttccctttggttagatacccagtagtgggattgctggatcgaagggtagatctatttttagttctttgagaaatctccatgctgttttccatagagattatactaatttacattcccaccaactgtgtataagtgtttctttttctacacatccttgccaacatctgctgtttcttgcttttttagtaatagccattctgactggtatgagatggtatctcattgtggttttaaattgcatttttctgatgattactgatgctgaacatttttttcatatggttgtttgccacttgtatgtcttcttttgaaaaatatgtgttcatgtctttgcctactctttaatggggttatttgttgtttttgtcattgtattgtttgatttcttcctaaattctggatattagtcctttgccagatgcattgtttccaaatattttctcccattctgaaggttgtgtgtttactctgttgattacttcttttgctgtgcagaagcctttaggtttaatgaagtcccattagtctatttttggttttgtcacatttccttttgaggacctagtgataagttctttgcctagaccaatgtccaaaagagtttttcctagattttatgattttattctagaatttttatagtttcaggtcttacatttaagttgaagactttatttcttaagaacaatttttggttcacagcaaaattgagcagaaagtacaaaatatacccctgcccccacacatgatagccttcccaccagagtggcacatttgttacacttgatgaacaaattctacacatcattatcattccacatccatagttcatatttttttttttttgagacggaatcttgctgtgttgcccaggctggagtgcagtggcgccatctcggctcactgcaagctccgcctcctgggttcacgccatcctcctgcctcagccgcccgagtagctgggactacaggcacccaccaccaggcccagctaattttttgtatttttagtagagacagggtttcactgcgttagcggtggtcttgatctcgtgacctcatggcacatttgttacagttgatgaacaaattgtacacatcattatcattccacatccataattcatattaaggttcacacttggtattatacattctgtgggtttgacaaatgtatactggcatatattccattagagtattgcaagaatcctctactccatctattcatccctccctcccctctaactcatggcaaccaactgacctttttactgtctccatggtttttgccttttctggaaggtcatttagttggaattgtgcagtatggagacttttttagattggcttctttcactttgtaatacgcatttaaggttcctccatgtcttttcatggcttgatagctcattttatttaagcgctgaataatattccattgtctggatgtatcacagtttattcattctcctactgaaggacatcttggctgcttccaagttttgggaattatgaataaagctgctgtaaacatccatgtgcacctgggtgtggtggtgcatgtctgtaatcctagttactgggaaggctgaggcatgaggattgcttgaggccaggagttagagaccagcctgagcaatgcagctagactctgtttctaaaaaaaaatttttttaagttaactttgtggtggcaactgctgcctgtagtcccagctattaaatggaaggctgaggcaggaggattgctcaagctcagtgtttcaaaactagaatgagctgtttgcaccacggccctccagcctggggcaacacagtgagaccttgtctctgaaaaaaaattccatgtgcagatacaatgtaattttaaaggatgtataaaatctatttatgatgcacagaaattacttaaccattgatttctgttgctgtaaaaatttttggctttgtatacgaagaattttttcagaattaatctgtcagatactatgttgagtttatatgatagtcagtagcaattaaaatagcatcacgctagatcatgagtgaaggtcagtattaggaattcaggactctgacaaagcagagttagcgctgtctgttactaacactaaggtttctcaagagggcagatttagagattaagcagttctccaaattcaggacaaattcagggagtcaggtggtttgagagaatggtatcataagaactctgatatgaggaagcccctcatatcagaggggcttgagacagtgtcttgctctgttgcccaggctggaatgcagtggtccaatcttggctcaagattgagaggattggcagtgcatcctctgcctcttgggttcaagcaacccttccacctcaccctcctgagcagctggaatcccaggcatgggccaccacacccagctaatgtagcttctgtggaagaggctttttgatcctcctatcatctttataattttctactaaccacagaattgggtagctgtgaaaccactaacttttaattgcacccagagctctgaggacactcagtagtttaggttcccttattactggatggcccttagaataaaggcacagcttaaaaatgtttttttttaatgccaggtctcgctgtgtttcccaggctgggtgcagtggctattcaaaggtacaatgatagctcactgcagcctggaactcctggactcaagcgatcctcctgcctcagctgcgactaacaggtatgtaccaccgcacccaactcataaatcattaaaccccttgaatttcataggtttagagttatgatcatggtaactctgcaattttgtattagctttaagtgctttcggttgcaaataacagaaaacttaatggtgatttaaagcgacaaggctttacttttttgcacctaataagaaagttgctggcattggttcagtagctctaaactgtgagaacttacttgctgctttgttttcacaagacagctactgttgctccagacatacatccacattcaagctggggaaaaggacaaggacctggtatcagccacatctttcccttttcatccagaaagcaaaagccttctcagacactcccagtagaatactgctttattctcatcatcagaacgatgccacctggccttttcaatgaagtctccagtactcaacaatattgctttctttttttcaaaaaattttgaaggatctggatttcgcttccggatcaacatagtatacagtggggccgggagcagtggctcacgcctgtaatcccagcactttgtgaggccagaccaggcagatcacttgaggccaggagttcgagaccagcatggccaacatggcgaaacccgtgtcttctaaaaatacaaaaaattagctgggtatggtggtgcatgccagtaatcacagctactcaggaggctgaagcaggagaattgcttcagcctctcccctccccacccctcctctccccgcctctcctttcctctcctctcctctcccttttcttttcaaaagtatttattggctgccatgtgtcagaggttgccgtgagctcagatcaggccactgcactccagtgtaggcaatagaacgagactatgtttcaaaaaacaaacaaaaaagcccccaaaccccacatggtatataatgggaatagcacatgcagaaacagaagctcagatacttaggtgagcttgaaaatttaagacctatgtaaatgtctagaaacgttttaaaggactttggacttcagaagagaataaattcagagtctaaacctatcttatttagatctcaaggaccaaagaagcctcattcaacatcagaattatgactgtggtgctcaaggagagatagaaaggaaaatgacagttctccatctgggagaaaaagatggttatttttcagaataagagattaaaggaacatgggggattaatgcctgctaatcttgatcttctctaagagtagtaaaaatcacctgccaagattacaacagatttgaaatcgaattggtgactagaaattggtgaagcattttaaaagatttattatggaaagtcttatgaagatgggcaataactgaacaaaaaagattgtgaaacatgaatgggggtccatttgaatcaagtagcctaacattgctgaatcctagttaatcacagtcttttgcctttcttcagtatcattttaaaacacctaagttataacactaaaagtgagggttatcccttactgtagagggagtctagttggttgatgggaaatctattggtattgctgataatgacaaagtgcaggctggagttggaaaataaggagtttgtaataaatgataacagcccttttcatataccactaacattgtattctaggcttcaaaggtaggttcaaccacaaattgaagagggtgtcttgcaatataagggtgacttagccttagaaaccctaacaattgttgcttttcatttgccttccttttttccttacttctttttccctccctgcctcttccttcctcccttctcttttactttttcctctccccttccctactctcccctcccctcccctcccctgctctcccctcccctcccctgctctcccctcccctcccttcctctgctctcctctcctttcccttttcttttcacaagtatttattggttgcctaccatgtatcaggcatgtttttaggtgttgtggatatagtagtgaataaaacagacaaaattcctactctgatggaacttacctaagctactaaacaaatgcatagtaagagtttagaactcatggaggaaattgaagcagcataatggaattgctgaggtgcgatgctcatggtgaggtgatgagaagtggattttttttgttttgttgtttttttatttttgttgtcgttgtttttgtttgagatgaagttttgctcttatagcccaggctggagtacagtggcacgatctcggctcactgcaacctctgcctccctggttcatgcgattcttctgcctcagcctactgagtagctgggattacaggcgcccaccaccatgcctgactaatttttatagttttagtagagacagggtttcgccatgttggccaggctggactggaactcctgaccacaggtgatccgcccgccctggcctcccagaatgctgggattacaggcgtgagccaccgcctggccaagaagtggttttgaaggaagaacctacagggcttggtgatggcttggatatgtggtgtagagtagagtaagtgaagcaccgaactttacctagttatgttgaacaatgtgactggacatagtttaggatgaggaatacattttcggccttgggtacagagtgaccttggagttgatttaatgaatgtagtactctagcagctttctgagccttatgagactgaaatctatattgttcacagtggactcaggaaaatactcacagaagtgattgctggtattgagagagtagcttcatgaaagtaggagtaggactctcctgcttgattatgatatcttcctccaaagaggagagccatatccctgactgaccaagcgttaatgtttaagtcatctggaataagaagaaaagctgaggaatgttagaggaagacactccttatatttcctttcatgtcgagggtattcagtgaaccactgtctttctattcctttgctttgagtggcttctttgattgataaattttgaaagacaaaaccgggcatgccagcctcatctttgaccttgttcctgttgatccggagctgcttacagggactgtgttctttgcctctgctttgtcttgccttgctgcgtaaatctggggttgaatgctaggaagtccatttgactctcgaagcaagggatggcctctgacttagcctttattaactatgaaagtggtcttcagtcctctctgtgccactccttaattttatatttcagtttactgagaaccctggtggggaagagaattactctttactgagtcccctagagaaccaagaagcagtaagagagtcacaccactttcttctgtttcatagcagtttgcaaaacagagtcacatgtgtgttatcatctatagctcccatttttctggtgaaggcattgaggtttatagaagttaaatgacaggaccaaacctatagaaactaaaagtagcagtgagatactatatctacagctccttactacaaatacaatgtttctttcttctcaccatgactactttggagatacattaaggataagttttctttttgtcactggggtggtgcatacatgcatcagagtttgagcagcagcatagggaatctctgtcaaattgtgaaaatagaaaacttgccactttatattttctggaaccctttcacattcattcatccatctcacatttgaaacatgtcagatttttcactggtatctgaaatgtattcaaatatatttccttgagaattgcccttcacggagtgtttaatttaaagtgctgaattctggtattaattttgttctgtttgttgacctggtgatatttgtggttcaactaagatataataatattccaacaatgttgaagaatctccacagcagctgccttccagtcacgtactttttaattcctccaccatagcagaatgcgctattaattattgcaaaattttaaaagtctcccgcttcacagtggaaactctgttgcgcttattttaatgtgaaggaaaatctaacatggtgagtacccaggagagtcgttatggatagacagcagtatagtatgaatggccctggaatgttgccatgtggcagtaaacccttatctccagccaagacccatgaacgcaaatagaaggaatgtgaattagccgtggaggctgtgcgtttactattaagagcaactgtgcaatctagttttcaagacccgtgctacccaaacacatttttctacattacataatgttatcatttaaatattgtcattcaaatgtgaagaccagctgtgcatatcaggacacagctgtcaggttgaggtgcagataagccatctggtgcctggttctaggtggttaaattccagctggggatttaacttcatatccagctgtgataaagtaaattgaaggctgcatattattcctcagaaatcactccttcgggataattctcagaaataaattttaaccagaggtggtgtcattgattggttttacactttcaattatagcatttgccagaataaaaccaaatgaaaaactgttccgtcgtttcattttctttgtatgaaataaaaccaaatagttaaagagaatgaagcttcttcagtcttcttcaaattacatctgttcagggacaatctgctgtcaaattacctgggttcacacatctctctagatgacaaaaagaaaaatcaggtgatccataaaagctgagtaggagagcaaagtggtaattatcctaatttccagaatcattatgtctggagatatgtgaaatatgagaaagcaacaccgttttaacaacagtcgtttcttgtgcttagacacacctctttctcgatttcgaatgttttcaaggaaaggacgttaaaatcctgccttgcccttttgtatgtgtggctaatcatggagtccaagaaggaaaaaaaacctgaaaaagtgagccttctccactgtcttcaggcatgtttgtgtataactacccaattatggaattaatctatattactgttaaacatcttcaaaggagtagacttttactgtaacttactgcaacattttagtgaatactgtatagattattttatctaaagcaaataacactaggatatattaagtaatgagtgagatagagttatggtatatattatgtatgttagctatcaaataatttagccaatatacaggtaaaatggtttcttctttctttaaaactaatttacttaattctggctggggtggtggctcaggcctgtaatcccagcactttgataggccaaggtgggcagatcacttgaggccaggagttacagaccagcctggccaacatggtgaaaccccgcctataacaaaaatacaaaaaactagccaagtgtggggcacaggcctgtaatcccagctgcttgggaggctgaggcagaaagaattgcttgaacgcaggaggcggaggttgcagtgagctgagatcatgccactgcactccagcctgggtaacagagtgagattctgtctgaagaaaacaaaaacaaaactaatttatgtaattctcccatccaagtactaaccaggcccgaccctgcttagcttctgagctcagacgagagcaggcatgttcagggtggtatggccatagactaatttatttaattctatcccacagctactgattggaaaaccaaccttgtatctctagatggaactttcttctggcagacacaattgctaatttaaataaactaagaagtgattgtgggtgtgtgtagagaaattattcagtaaagacaacattttcttttcaaaatgtgtttagggaaaatcttgtaggaggagtatgtgaatcaacggaatccagagataagtatactaatgcaaacttcaaatgcaaaccttcagatttggcagtttattttccttttgattctacatgcagaacgcttaagttcaggacttgtttctaaaggtttgagatgtctaagataaaccactgaaagtggtatattgtcaaaaaaactgaagggagattatatttcttttgcgtgtgtttgtggagggaagagaatttaaacaaatattttttggaagccagtcatggtagcttatgcttgtaaggcttatgcttgtaatcccagcattttgggagcacgaggagggatgtttgcttgaggttaggagttcaagaccagcctgggcaacatagtgagactgtctctaccaaaaataataagaaaattagccaggtgtggtggtgcatgcttatagagacagctactggggaggctgaggtaggaggattgcttgagaccaggtatttgaggttacagtgaactaggatcataccagagcactccagcccgggtgacagaataagaccctgtctctacaaaaaaaaaaaaggttttttagaattggcatcaggattatacactaattagcaatttctccaaaatatgttttaaaaatcttattaatacattgaatacaaaataaagaaatctcccctttaaattctataggtgcctgtactctacattccattccctggactaactggggctaacagtagcaatataagcaactttgtggagcacagaaaggcaggccttgatttcacggaaattattagtcaaaagtgagaaacaacaaggagaaaacaagtttaccaaaattctaaatttacaaaggttctaaactcctactatgcctcctgtttttagattttaactgttgacagttgttaaatttgagactatttctcttctcatctagaatacttaaaaaataattttttcatgctttttttactacaaggttttgtacattgaattgaagacaatgaaaaactaaactgaaagttgctgctacttggtgttagaggtttcattacttgactgaaaaaaaattaattttactgaactcaccatgccgctccaaagcccttcagtgatggcaaatagccccttcttccttacaacaaaaaggctgtaactgggagggaaagtgtaaggaaaaccaattttcagcgacttcggctgttcactttatgtgaattctctttcttttgaaaatgggaggtgagcaagaatctcctgagttagtgaattttaaaaatacttgaaggtaggccgggcacggtggctcacgcctgtaatcccagcactttgggaggccaaggcaggtgggtcacctgaggtcaggagttcgagtccagcctggccaacatggtgaaaccccgtcactgctaaaaatacaaaaattagccaggcgtggtggcacacgcctgtaatcccagctactcgggaggctgaggcaggacaattacttgaacccaggaggcggaggttgcatgagccgagatcgcaccattgcactccagtctgggtgacaaaagcgaaactccgtctcgaaaaaaaaagaaaaaaataaaaatacttgaggataaatatataatataatccctgtatgggaaaatgtaagggaaaaatggggaatggtggaaagtacccaagtcaattagtgttcatattaagggacaggttgaagagtcagaccttctacaataaaaaagaggtttttggcttatttttcattttcctgactctgccatgagttttggtttccctctaggagatgtgaggagcctaaatatgtcaatatgtcatgtatgtatacaataacatcatgacgatgaacagctaccacatattgtgtacttaccaagaacctagtactatcctgagtatttcatgtgttaacttatttaatcctctcactattattatccatgctttataggcgaggaaaagaaacccagaaaggttaagcaacttgtccaaattctcccaaatagtacagctagcataccaacccataatatctaattccagaaaccacattattttcttttaaattatacttcttccaaactaataggtcatgttatattacataataacatccgattgtgtctcataaacaactaagactcagaatgtacccacacaccacccacctgcactctttctccttaaacaaccaaccaaagaaatgattatgttgaggatattttaaatatgctagattagtaatcctctcattatttttctttaagtaaaataatttaaggaaagtaacttgaagatgatgaagtgaaaggcaacagaataatttagcttctaaaatgggtattagagtacagagaacttaagcagctttgactttaagagggttacctaaattgtaatcaaatgcatttcaaaaatcccaaacagcaaaggacaaagtttccatatccatatataccctgaagacaggacaagaagaattttgctcaacaggtaggtttagtttagacataaataaatctttccaggactctgtgacctaaatcaaagccatagagaatcacttggtcactgttatcacaactcatgtacctgttaaggtcaatactgtatcactaacatttcttccacctctataattttattgaacctaaccaacagtcaaggtagatgctctgtccccctactattcaaactgatatgacttgattataagggctgtgatacaaataactgctaaaggtgattatttaatcattggggaattacagaaaaagcagtatgatgaatgcttgattcgtgatggatactccaattttcctgatttgatcgttatacattgtgtgcttgtatcaaagtatcacatgtaccccataaatatgtacaactagtatgaattcataataataaaaagcttaaaaatccagtattattaccatcctatgggagctgaatggtggtgttttacaatttattttcaaatctttatataatatctcagataaacttaattaaattctaaccaacatgggtttgataatcatggatttagcctattcgtgggttagaatcctctagtcaagcatctagtttaggttaaaaacaaacaaacaaatattcttgctgggaaaacattatgataatcaaaattacaatttaatagaagacataatcctctctgaaggaaagattttaagctaaattttaacataaaaaaatgcacagtcagctcattgctagttgtttggaagaggaacaaaagaacatttcattttgaacaaaaactaaattatctaaacagttacttgacatttataaaaacggtaagtcttatgaagcatcaattaatcttgcaagtgcaaatctatgtattactaatcctttaatcatcatattgctattatctggctgttccaaattttctcggtccaccccaagttatgaaacctagattattggtaaaatagggcctggaggaacaaaatggaacacttctttatcatttttttaatacaaagatatgacattgcaaacttgtggtatgtgtttgaatctatgttctatcaggctatatttcctatgtatgtaacccgtttgatcttaatgagcagttttaaaagttctggttccttcaataatttattctaagtcactattaaatttcatcccatcttccaaaattcttcatccctttcaacaggtttggtgacatttcaaggttaataactactgaggataatatgaaagaaaatctggttaagatgaagcccaaaatattaggttattttttatttttatttatttatttatttgttttgagatggagtcttcctctgtcacccaggctggattgcagtgaagcaatcttggctcactgcaaactccacttcccaagtccaagagattctcccacctcagcctcccgagtagctgggattacaggtgcatgccaccacacccagctaatttttgtattttattagagaagggttctgccatttggccaggctggtctcgaacccctgacctcaagtgatctgcctgccttggcctcccaaagtgctgggattacaggcgggagcaactgcgctcagccaacattaggttatttaaatatgagacgtttcttcacaaagaggcttattagattttatatacttgaatataaattaccctcttttatctgttggttataaacattctcatttatctgacgtgaagtaattgtaataattttaggagaattgggaaggaagtagttaaccttaaaaactcatctcatgaatgtaggtatgacatatacaatcttgggtaggaagtgatgaaatggtagctgtctaaggcactattctcagagtagaagagactgtttaacggtgattaatgggaatgtcatggcatacttgaggctgcctagtgatggaggcgtaggagatcgtcttgtcagagtgactttaaaggcccaagcttcccactcacttttcagaaaaatgcagtacccagggctcggttgaaaatccagagctggggctgggcacagtggcttacaccaatagtcccagaacttcatgaggctgagtctcagcacgtgagtttgagaccagcctggggaacgtggcaaaaccacttctggacaaaaactataaaaattagccaggcatggtggtgtgcgcctgtggtcccagctactcaggaggctgagatgggaggatggcttcagcccagggaggtcaaggctgcagtgagtggtgatcatgccactgcgctccagcctgggtgacagcgtgagactctatctcaaaagaaaaagaaactgcagagctgaagcaccatgcagtcatacccagagttgaatgagaaaagcaaacctttcatataaattaggtgatatagactcgtgcttaaagatatatatttgagcaagtgcaagcaaaggctaaggcttactagtgaggaaattcaaaaacgtatgcctgatgtcctggtgcaaaggaagcacagcagagtgggtaagactacaaaccctggagtcttcaggtgtatctgtttgaacccactatataaattttgttgtttgtagtatagaactatgtttttcatattgtagaaagttttcatttcatctaactatttccttgcttatttgatgtgttagtccatcttcctaataaaatcctctgttttgccaagaatttcagtttcttcagtggattcttttatcatcttcataaaaggcagaggagatgtctgggtagtgcacacagttgtgtcataaaagctggtgtctcttctgagagtctgggtatcctttctgattagctagtgctgatgagtcaaaaataaatcatttgggccgagcgcggtggctcatatctgtaatctcagcactttgggaggccgaggcaggtggatcacctgtgatcaggggtttgtaaccaatctggccatcatgccgaaaccccgtctccactgaaaataacaaaaattagctgggccctgtggcgcacacctgtaatcccagctatttgctgtgtcacccaggctggagtgcagtggcacaatctcagctcactgtagccttctccgcctcctggattcaagtgattctcttgcctcagcctcccaagttgctgggattataggcgtgtgccatcatgcccagctaatttttgtattttttagtagagatgtgagttcgctatgttggccagcctgggaccatttagattattttcaatttaatcacttttattgaagtatataagttatactagatttgtatgtatagcttacatatatttcttatagaaagtataaaagtatacatgtgtgtatgtatgagtgtacaaatattaagtatataacttgatgaatttttacatgtaaaaattcaccaatgcaatcaccagttagatcaagttatagaacattttcagcatctccccttagttaatttctacctccttccaaaaataagccctgttcttatctctattgccacagaacagtttgcctgctcttgaacttcacatacatgaaaccatacagtctgcattcttttatgtgtggcttctttatttcaacactacatctgtgaaattcatatacatcactgcacgtagctatagttccttctttttcattcttgtgtagcacattgttctacagcctgtttatccattgtggtattgattgattgcattgtttccaatttgggctagctgttactagtatgtttgcatatgttctcgagtagacataagcattcatttctgtagtgtgtgtacctacaactcattgctcttaagcaaggtaagtaaggcacctttgtccatttcttggattctacctatctgcctaaagggagattaactcccttcatatgctgaaatcctctttgtgtaggaattgtttccttgctcatttgatatgttcatctatctccctaataaaagcttctgttttgtcaagaaagcaaaacagagttgaagtgatagctcgtaagatttaagcatgaaggtctaacaggactatgccacaggcagagatcaaaaaaaagaaaaaatgataattttatcattaaacccacggtctcagcccaaattctctgctccagaaaagctaatccaaacatttcagaaactgtcattacctgcagcaatttccaactcattcctacaaaaatgtaagaggcatgcacagcttcttacagcaccctgatctttgagagagaaatgccagctcttctctgcctcatgacttataccttcaggcagaggaaggaaaagcagtgtgaattatgtttacatatgcttaggaattgcatttgacaaggcataatgaatcagcgatgttttcttgtttggtttctgtctcaaaattgatctagctccaagtttagaagaccctacgacgtgactcagtaagtggcctcaccttcatccgattgctcagaattaaaacctagaagtcatccttgattttctcctctcaaatctgtctccattcatcagcacgtgcttttgactcgatgaaacgctccaaacacaactgcttcccaccgcctccactgctgcctcttgtccctgcagcatcatctctcacccacattggccacagcggcttgttgttggtgttcctgcttctacttttgacttgtttctattgtcttccatgcccactggaactgtaattattttttgcaaatgtaagttagataatgacattccactgttaaaaaaaaaacaaaacagaaaacaaaatgaaagaacaaaataaaaatgtctagtgaccccctgttacacctagccgaaaatccttacttggcccagaagggcctagattctcagtcttgactgcacatgggaaatcacctggggacttgaaaaatactgactttagctgggtctggggaattgtgtgtgtgtgtatgtgtgtgtgagatggagcttcgcttttattgcccgggctacagtgcaatggcaccatctcagctcaccgcaacctccgcctccccagttcaagccgttctcctgcctcagcctcccgagtaggtgggattacaggcatgcaccatgacgcccggctaattttttctatttttggtagagacgggggtttctccatgttggtcaggctggtctcgaactcctgacctcaggtgatccacctgcctcggcctcccaaagtgctgggattacaggcgtgagccaccgcgcccagccggcacagggaatttaaaagcttcccagaagtttctgatgtataaccaagattgagagctactctaggatccttccaccactctcttcctctctctatctccaccccagttgcttacttgctgtgttttgagcacactctgatcctttccaccccaaagcatggatcattcttgccccagatatttgcatgagctattctttcacacaaagaggtctctgctcaaatgttaccttttcaaatatattttccccaacgaacctacctaatgactatttttttaccctgtatatttttagtttttatatgaaattatattacttgcttctttacctgtttattggtgctcttcctcacaagcatgtaagtgcatgaagatagacaccttgtcttattcactaagacattatcaccctggcatatagcgtgcttggaactcattctctgattagtgtttttcagtgaaaaaaatgaggattactcaaggttctgggatctggatttgctacaagtagctaattgtagcttatggattctctggtttgtaaggcttttgttgcttttgttctatttgcaaccctagactttccttccagaaatagtcatctgggcgtggtgcctcacacatgtaatccccatactgacacaggtcgatcacttgaggccaggagttcgagatcagcctggccgatatggtgaaatcccctctctattgaaaacacaaaaaactagccaggtgtagtggcgggcgcctgtaatcccagctactcaggaggctgaggcaggagaatagcttaaacccaggaggtggagattgcagcgagcccagattgccccactgcactccagcctgggcgacagagggagactttgtctcaaaaaaaaaaaaaaagtcaaggagtcttttgcttttacttgcttacctatgccgctatattttacattcaacttccttctgatacacaggaaggactgtgtctgcttggactggacacagttggactttcaagtgagttggctggctgtgggtctttgattattcctctctgttagaggggcagaatccaccattttcttaggagaatggtgcaagtgggaaatccttgtcctataggctgaaggccagtcacttctctctctctctctctctttctttctttctctctctcaatagggtctcactctattcctgggctggagtgcagtgacactatcacagtgcaccatagcctcaacctcctggactcaggtgatcctcctacctcagtctcccaagtagctgggactacaggtatgcgccattattcccagctattttttattatcttttttgtagagatggcgtttcaccattttgcccaggctacttctctctctctttattcatgcttcctttcactttttgatatctaagccttgcccatctctttttctcagccagggggatggatctacacatagaggacttaagctctaggtacagaccttccacatacctgtctgcctatccctggcttaggtctgggtcctggtcactcacaaagaggtccaagatgggtatattgcagctccaaggcaagtaaatgctgcaaatctttctcctgaattagaacttgaataaaggaggagtcagagtccaaaatcaccctccagcattgaggctgtgggcttacagtggtcgggagcgtctgagtgctaactcttcctggctaaagattgatttctcaggaatagaaaatctcattcatattcatgtcgtaggatctttcaacatgctacggtgctaatattatttcattattataatcttgggagttattttcctggtgaagaaccagatgtatgagagattaagttattggtctagagtcatatagcttgtgagaagaactgaggtttgaacttatcatttgactacaagaactgtgcatgctacattttaccacattacttttctaaaactaagagaaaatacaatgaaaaagtgagagaggtgagaaaaaaatggagaaactaagatggagaaagaataaaaagagtgaaataaattttactttggattggtgaatagaaactgatctggctattttaagcagaaaaggattttctgtagtggattaagtgctaataagaacatacatatgatgatgacacaaaagtgggaacagtccttttttgaaaaagcgaaaataagaaaagtcaaagatgtcctaaatgtacatggctaaatgttttttaaaattggagtgattctgaaacataatatgtaaaaaattctgcaacatatgggcaacaggaaataggaaaatgattatgacagataaaaaacaaaacttttttgactgtatgccatgcatgaaagctcaacattaagggagtttataaagcccttacaagagtttctgcatatagagagagatcaataagtactagctattagtatcactatcctaacgtttacccaggagaaaccatagactacatatatcatgtggaaagtgccaactcacacaatttttgttgcaaactccaggtagttgactattttgaaagtcccttcaagtcttctattgtcaagataagtgacaaggcacccgcctatggagggctccagattcaatatttggtaaggtggctccaaacacatctgagacataaggttggtggtgccagcctcaatagattctgttcttgcttttttctttttttaaattataagtcatatactccttacgtcaaatcaaacagcagagatgtatgaagagaaagttcagaaatgcagccaaatcaaatttcccatctaattttgctaacgaatgttaatggctgtatgccagtccacacatttccaatcagtgcatttcaaattcaggtaacgtttgttcattttggaaaaagttacaaaatagaagctaggagtaaaatagcatgccttcaaaagaatttcatttcagagaattattggtggaaatacaaagacagtaagcttaattcctttatggatatatgaacaaaaggacttagaacaaacaaattacctttatagtattttgttagttaactataaaaataaatttttgttggtattattctggaaaaaaaaagaatgcttattaaacaagactgtgagctccttaaggattggtattatcataaaacctagcaaagaaccaacctcaccatgtgatgggtattttctaagtatttgttaaaattttaaaaaagaacatttaaactccattaaatgccaggctttttgtttctata
